US009708619B2

(12) United States Patent
Ren et al.

(10) Patent No.: US 9,708,619 B2
(45) Date of Patent: Jul. 18, 2017

(54) METHODS FOR CONTROLLING GENE EXPRESSION USING TA-SIRNA

(75) Inventors: Peifeng Ren, Cary, NC (US); Hee-Sook Song, Raleigh, NC (US); Yuwen Wang, Apex, NC (US); John McMillan, Raleigh, NC (US)

(73) Assignee: BASF Plant Science GmbH, Ludwigshafen (DE)

( * ) Notice: Subject to any disclaimer, the term of this patent is extended or adjusted under 35 U.S.C. 154(b) by 2040 days.

(21) Appl. No.: 11/992,332

(22) PCT Filed: Sep. 20, 2006

(86) PCT No.: PCT/EP2006/066521
§ 371 (c)(1), (2), (4) Date: Mar. 20, 2008

(87) PCT Pub. No.: WO2007/039454
PCT Pub. Date: Apr. 12, 2007

(65) Prior Publication Data

US 2010/0192237 A1 Jul. 29, 2010

Related U.S. Application Data

(60) Provisional application No. 60/718,645, filed on Sep. 20, 2005.

(51) Int. Cl.
*C12N 15/82* (2006.01)

(52) U.S. Cl.
CPC ....... *C12N 15/8218* (2013.01); *C12N 15/825* (2013.01); *C12N 15/8209* (2013.01); *C12N 15/8261* (2013.01)

(58) Field of Classification Search
USPC ...... 435/6, 91.1, 91.31, 455; 536/23.1, 24.3, 536/24.5
See application file for complete search history.

(56) References Cited

U.S. PATENT DOCUMENTS

| | | | | |
|---|---|---|---|---|
| 2006/0174380 | A1* | 8/2006 | Carrington et al. | 800/285 |
| 2006/0200878 | A1* | 9/2006 | Lutfiyya et al. | 800/285 |
| 2007/0066521 | A1* | 3/2007 | Fauquet | 514/12 |
| 2007/0111227 | A1* | 5/2007 | Green et al. | 435/6 |
| 2008/0229456 | A1* | 9/2008 | Huang et al. | 800/285 |

FOREIGN PATENT DOCUMENTS

| | | |
|---|---|---|
| WO | WO-2004/009779 | 1/2004 |
| WO | WO-2005019453 A2 | 3/2005 |
| WO | WO2006/074400 * | 7/2006 |

OTHER PUBLICATIONS

Allen et al., Cell, vol. 121, pp. 207-221 (2005).*
Yoshikawa, 2013, Genes Genet. Syst., 88:77-84.*
Wu et al, 2012, Plant Phys., 160:990-999.*
Meins, F., et al., "RNA silencing systems and their relevance to plant development", Annu. Rev. Cell. Dev. Biol., 2005, vol. 21, pp. 297-318.
Kim, V. N., "Small RNAs: classification, biogenesis, and function", Mol. Cells, 2005, vol. 19, No. 1, pp. 1-15.
Bartel, B., "MicroRNAs directing siRNA biogenesis", Nat. Struct. & Mol. Biol., 2005, vol. 12, No. 7, pp. 569-571.
Xia, H., et al., "siRNA-mediated gene silencing in vitro and in vivo", Nat. Biotech., 2002, vol. 20, pp. 1006-1010.
Yoshikawa, M., et al., "A pathway for the biogenesis of trans-acting siRNA in *Arabidopsis*", Genes & Development, 2005, vol. 19, pp. 2164-2175.
Xie, Z., et al., "DICER-LIKE 4 functions in trans-acting small interfering RNA biogenesis and vegetative phase change in *Arabidopsis thaliana*", PNAS, 2005, vol. 102, No. 36, pp. 12984-12989.
Ascenzi, R., et al., "Analysis of trans-silencing interactions using transcriptional silencers of varying strength and targets with and without flanking nuclear matrix attachment regions", Transgenic Res., 2003, vol. 12, pp. 305-318.
Voinnet, O., "Shaping small RNAs in plants by gene duplication", Nature Genetics, 2004, vol. 36, No. 12, pp. 1245-1246.
Willmann, M. R., et al., "Time to grow up: the temporal role of smallRNAs in plants", Current Opinion in Plant Biology, 2005, vol. 8, pp. 548-552.
Williams, L., et al., "A database analysis method identifies an endogenous trans-acting short-interfering RNA that targets the *Arabidopsis* ARF2, ARF3, and ARF4 genes", PNAS, 2005, vol. 102, No. 27, pp. 9703-9708.
Vance, V., et al., "RNA silencing in plants—defense and counterdefense", Science, 2001, vol. 292, pp. 2277-2280.
Zamore, P.D., "RNA interference: listening to the sound of silence", Nat. Struct. Biol., 2001, vol. 8, No. 9, pp. 746-750.
Peragine, A., et al., "SGS3 and SGS2/SDE1/RDR6 are required for juvenile development and the production of trans-acting siRNAs in *Arabidopsis*", Genes & Development, 2004, vol. 18, pp. 2368-2379.
Vazquez, F., et al., "Endogenous trans-acting siRNAs regulate the accumulation of *Arabidopsis* mRNAs", Molecular Cell, 2004, vol. 16, pp. 69-79.
Allen, E., et al., "microRNAs and trans-acting siRNAs in Arabidopsis", Keystone symposium, abstract No. 102, 2005, p. 38.
Allen, E., et al., "microRNA-directed phasing during trans-acting siRNA biogenesis in plants", Cell, 2005, vol. 121, pp. 207-221.
Jones-Rhoades, M. W., et al., "Computational identification of plant microRNAs and their targets, including a stress-induced miRNA", Molecular Cell, 2004, vol. 14, pp. 787-799.
Kasschau, K. D., et al., "P1/HC-Pro, a viral suppressor of RNA silencing, interferes with *Arabidopsis* development and miRNA function", Developmental Cell, 2003, vol. 4, pp. 205-217.
Remington, D. L., et al., "Contrasting modes of diversification in the Aux/IAA and ARF gene families", Plant Physiology, 2004, vol. 135, pp. 1738-1752.
Watson, et al., "RNA Silencing Platforms in Plants", FEBS Letters, 2005, vol. 579, pp. 5982-5987.

* cited by examiner

*Primary Examiner* — Jason Deveau Rosen
(74) *Attorney, Agent, or Firm* — Drinker Biddle & Reath LLP

(57) ABSTRACT

The present invention is in the field of genetics, especially plant genetics, and provides agents capable of controlling gene expression. More specifically the inventions relates to methods for engineering ta-siRNA primary transcripts in order to target gene-of-interest (GOI) and control their expression. The invention further provides for a method for modulating transgenic expression by said engineered ta-siRNAs.

27 Claims, No Drawings

METHODS FOR CONTROLLING GENE EXPRESSION USING TA-SIRNA

RELATED APPLICATIONS

This application is a national stage application (under 35 U.S.C. 371) of PCT/EP2006/066521 filed Sep. 20, 2006, which claims benefit of U.S. Provisional application 60/718,645 filed Sep. 20, 2005.

SUBMISSION ON COMPACT DISC

The contents of the following submission on compact discs are incorporated herein by reference in its entirety: two copies of the Sequence Listing (COPY 1 and COPY 2) and a computer readable form copy of the Sequence Listing (CRF COPY), all on compact disc, each containing: file name: Sequence Listing—13987-00089-US, date recorded: Mar. 20, 2008, size: 1.31 MB (1,379,182 bytes).

FIELD OF THE INVENTION

The present invention is in the field of genetics, especially plant genetics, and provides agents capable of gene-specific silencing. The present invention specifically provides polycistronic RNA molecules capable to generate double-stranded RNA (dsRNA) agents, methods for utilizing such molecules and cells and organism, especially plants, containing such molecules.

BACKGROUND OF THE INVENTION

Many factors affect gene expression in plants and other eukaryotic organisms. Recently, small RNAs, 21-26 nucleotides, have emerged as important regulators of eukaryotic gene expression. The known small regulatory RNAs fall into two basic classes. One class of small RNAs is the short interfering RNAs (siRNAs). These play essential roles in RNA silencing, a sequence-specific RNA degradation process that is triggered by double-stranded RNA (dsRNA) (see Vance and Vaucheret (2001) Science 292:2277-2280, and Zamore (2001) Nat Struct Biol 8:746-750 for recent reviews on RNA silencing in plants and animals, respectively).

One recently identified group of small RNAs are known generically as short temporal RNAs (stRNAs) and more broadly as micro-RNAs (miRNAs). miRNAs have emerged as evolutionarily conserved, RNA-based regulators of gene expression in animals and plants. miRNAs (approx. 21 to 25 nt) arise from larger precursors with a stem loop structure that are transcribed from non-protein-coding genes. microRNAs in plants and animals function as posttranscriptional negative regulators (Bartel D (2004) Cell 116, 281-297; He L and Hannon G J (2004) Nat. Rev. Genet. 5, 522-531). Plant miRNAs target a disproportionately high number of genes with functions in developmental processes, including developmental timing, control of cell proliferation, meristem identity, and patterning. Global disruption of miRNA biogenesis or function, or disruption of specific miRNA-target interactions, generally results in developmental abnormalities (Achard P et al. (2004) Development 131, 3357-3365; Chen X (2004) Science 303, 2022-2025; Emery J F et al. (2003) Curr. Biol. 13, 1768-1774; Juarez M T et al. (2004) Nature 428, 84-88; Kidner C A and Martienssen R A (2004) Nature 428, 81-84; Laufs P et al. (2004) Development 131, 4311-4322; Mallory A C et al. (2004) Curr. Biol. 14, 1035-1046; Palatnik J F et al. (2003) Nature 425, 257-263; Tang G et al. (2003) Genes Dev. 17, 49-63; Vaucheret H et al. (2004) Genes Dev. 18, 1187-1197), indicating that miRNA-based regulation is integral to pathways governing growth and development. Plant miRNAs usually contain near-perfect complementarity with target sites, which occur most commonly in protein-coding regions of mRNAs (Llave C et al. (2002) Science 297, 2053-2056; Rhoades M W et al. (2002) Cell 110, 513-520). As a result, most plant miRNAs function like siRNAs to guide target RNA cleavage (Jones-Rhoades M W and Bartel D P (2004) Mol. Cell. 14, 787-799; Kasschau K D et al. (2003) Dev. Cell 4, 205-217). In contrast, most animal miRNAs and possibly some plant miRNAs function to repress expression at the translational or cotranslational level (Ambros V (2003) Cell 113, 673-676; Aukerman M J and Sakai H (2003) Plant Cell 15, 2730-2741; Olsen P H and Ambros V (1999) Dev. Biol. 216, 671-680; Seggerson K et al. (2002) Dev. Biol. 243, 215-225). Although many animal target mRNAs code for developmental control factors, no miRNAs or targets are conserved between plants and animals (Ambros V (2003) Cell 113, 673-676).

In plant, majority of miRNA target genes are transcription factors, which are required for meristem identity, cell division, organ separation, and organ polarity. Some miRNAs have unique tissues-specific and/or temporal expression pattern. McManus et al. (RNA 8:842-850 (2002)) also studied miRNA mimics containing 19 nucleotides of uninterrupted RNA duplex, a 12-nucleotide loop length and one asymmetric stem-loop bulge composed of a single uridine opposing a double uridine. Synthetic miRNA can either be transfected into cells or expressed in the cell under the control of an RNA polymerase III promoter and cause the decreased expression of a specific target nucleotide sequence (McManus et al. (2002) RNA 8:842-850).

The mechanism of miRNA-mediated gene silencing is only slowly becoming clearer: microRNAs form through nucleolytic maturation of genetically defined RNA precursors that adopt a self-complementary foldback structure (see Allen E. et al. (2005) Cell, Vol. 121, 207-221 and the references cited therein for details). Processing yields a duplex intermediate (miRNA/miRNA*) that ultimately provides the miRNA strand to the effector complex, termed RISC (Khvorova A et al. (2003). Cell 115, 209-216). Plants contain four DICER-LIKE (DCL) proteins, one of which (DCL1) is necessary for maturation of most or all miRNA precursors (Kurihara Y and Watanabe Y (2004) Proc. Natl. Acad. Sci. USA 101, 12753-12758). The DCL1 protein contains an RNA helicase and two RNaseIII-like domains, a central PAZ domain and C-terminal dsRNA binding motifs. HEN1 functions in miRNA biogenesis or stability by methylating the 3'-terminal residue (Yu B et al (2005) Science 307, 932-935). In *Arabidopsis*, HASTY (HST) provides a related function for miRNA transport (Park M Y et al. (2005) Proc. Natl. Acad. Sci. USA 102, 3691-3696). Active miRNA-containing RISC complexes in plants almost certainly contain one or more ARGONAUTE proteins, such as AGO1 (Fagard M et al. (2000). Proc. Natl. Acad. Sci. USA 97, 11650-11654; Vaucheret et al. (2004) Genes Dev 1187-1197). In addition to miRNAs, plants also produce diverse sets of endogenous siRNAs. These differ from miRNAs in that they arise from double-stranded RNA, which in interacsome cases requires the activity of RNA-dependent RNA polymerases (RDRs). *Arabidopsis* DCL2, DCL3, RDR1, RDR2, and RDR6 have known roles in siRNA biogenesis (Dalmay T et al. (2000). Cell 101, 543-553; Mourrain P et al. (2000). Cell 101, 533-542; Peragine, A et al. (2004) Genes Dev. 18, 2368-2379; Vazquez F et al. (2004b) Mol. Cell. 16, 69-79).

Ta-siRNAs are genetically defined at specific loci and arise by phased, DICER-LIKE processing of dsRNA formed by RDR6/SGS3 activity on RNA polymerase II transcripts. Ta-siRNAs interact with target mRNAs and guide cleavage by the same mechanism as do plant miRNAs Peragine, A et al. (2004) Genes Dev. 18, 2368-2379; Vazquez F et al. (2004b) Mol. Cell. 16, 69-79). Those ta-siRNAs regulate the accumulation of targeting mRNAs (Vazquez et al., 2004, Mol Cell 16: 69-79). ta-siRNA biogenesis is directed by certain miRNAs in *Arabidopsis* (Allen E et al., Keystone symposium abstract 102, Jan. 8-14, 2005, Allen E et al. (2005) Cell 121:207-221). In brief, for example *Arabidopsis* miR173 targets single-stranded non-coding RNA transcripts and directs biogenesis of ta-siRNA via 5' initiation, i.e. from miR173 target site, a double-stranded RNA is produced by RdR6 (an RNA-dependent RNA polymerase) along non-coding RNA transcripts, then 7 to 8 of 21-nt phases of ta-siRNA are generated by Dicer starting from a cleavage site of miRNA and target mRNA duplex (between position 10 to 11 of miR173) in 5' to 3' direction. Some of ta-siRNAs initiated by miR173 target mRNAs with unknown function. In contrast, *Arabidopsis* miR390 targets a single-stranded non-coding RNA transcript and directs biogenesis of ta-siRNA via 3' initiation, i.e. from miR390 target site, a double-stranded RNA is produced by RdR6 along a non-coding RNA transcript, then 7 to 8 of 21-nt phases of ta-siRNA are generated by Dicer starting from a cleavage site of miRNA andtarget duplex (between position 10 to 11 of mi390) in 3' to 5' direction. MiR390 target site in the non-coding RNA transcript and two 21-nt phases of ta-siRNAs, 5'D7(+) and 5'D8(+), initiated by miR390 are conserved across many plant species. These ta-siRNAs target ARF3 and ARF4 (Auxin Response Factor). These data support a model in which miRNA-directed formation of a 5' or 3' within pre-ta-siRNA transcripts, followed by RDR6-dependent formation of dsRNA and Dicer-like processing, yields phased ta-siRNAs that negatively regulate other gene expression (Allen E et al. (2005) Cell 121: 207-221 and figure below).

Plants and animals use small RNAs (microRNAs [miRNAs] and siRNAs) as guides for posttranscriptional and epigenetic regulation. In plants, miRNAs and trans-acting (ta) siRNAs form through distinct biogenesis pathways, although they both interact with target transcripts and guide cleavage. An integrated approach to identify targets of *Arabidopsis thaliana* miRNAs and ta-siRNAs revealed several new classes of small RNA-regulated genes, including conventional genes such as Argonaute2 and an E2-ubiquitin conjugating enzyme. Surprisingly, five ta-siRNA-generating transcripts were identified as targets of miR173 or miR390. Rather than functioning as negative regulators, miR173- and miR390-guided biocleavage was shown to set the 21-nucleotide phase for ta-siRNA precursor processing. These data support a model in which miRNA-guided formation of a 5' or 3' terminus within pre-ta-siRNA transcripts, followed by RDR6-dependent formation of dsRNA and Dicer-like processing, yields phased ta-siRNAs that negatively regulate other genes.

The coincident register of miRNA-guided cleavage and phased Dicer-like processing of ta-siRNA precursors support the hypothesis that miRNA targeting of primary transcripts sets the 21-nucleotide phase for accurate ta-siRNA formation. Thus, seven siR255 or related ta-siRNAs (siR850, siR289, siR752, and siR438[+]) from the three TAS1 loci are all in phase relative to the respective miR173 target sites even though they originate from different positions.

MIR390 genes, miR390 target sites and ta-siRNAs in TAS3 primary transcripts, and TAS3 ta-siRNA target sites in ARF3 and ARF4 are all conserved between monocots and dicots, indicating this pathway is at least a few hundred million years old (Allen, 2005). Allen proposes a model based on a DCL-catalyzed processing of pre-ta-siRNA duplexes, which starts from ends that are defined by miRNA-guided cleavage.

ARF3 and ARF4 transcripts are targeted by TAS3 ta-siRNAs (Allen, 2005). Thus, nearly one third of all ARF genes (23 known or predicted) are regulated by either miRNAs or ta-siRNAs. ARF10, ARF16, and ARF17 are targets of miR160, while ARF6 and ARF8 are targets of miR167 (Jones-Rhoades and Bartel (2004) Mol. Cell. 14:787-799; Kasschau et al., (2003) Dev. Cell 4:205-217). The ARF proteins are transcription factors that transduce auxin signals during growth and development (Remington et al. (2004) Plant Physiol. 135:1738-1752).

Various patent applications disclose the use of dsRNA, miRNAs and siRNAs:

WO 99/07409, describes specific compositions consisting of particular dsRNA molecules combined with certain antiviral agents. WO 99/32619 and U.S. Pat. No. 6,506,559, describe particular methods for introducing certain long dsRNA molecules into cells for use in inhibiting gene expression in nematodes. WO 99/49029 and WO 01/70949, describe certain vector expressed siRNA molecules. WO 99/53050 describes certain methods for decreasing the phenotypic expression of a nucleic acid in plant cells using certain dsRNAs. WO 00/01846, describes certain methods for identifying specific genes responsible for conferring a particular phenotype in a cell using specific long dsRNA molecules. WO 00/44914, and WO01/68836 describe the use of specific long (141 bp-488 bp) enzymatically synthesized or vector expressed dsRNAs for attenuating the expression of certain target genes. WO 00/63364, and WO01/04313, describe certain methods and compositions for inhibiting the function of certain polynucleotide sequences using certain long (over 250 bp), vector expressed dsRNAs. WO 01/29058, describes the identification of specific genes involved in dsRNA-mediated RNAi. WO 01/36646, describes certain methods for inhibiting the expression of particular genes in mammalian cells using certain long (550 bp-714 bp), enzymatically synthesized or vector expressed dsRNA molecules. WO 01/38551, describes certain methods for regulating polycomb gene expression in plants using certain dsRNAs. WO 01/42443, describes certain methods for modifying genetic characteristics of an organism using certain dsRNAs. WO 01/49844, describes specific DNA expression constructs for use in facilitating gene silencing in targeted organisms. WO 01/53475, describes certain methods for isolating a *Neurospora* silencing gene and uses thereof. WO 01/68836, describes specific methods for attenuating gene expression using endogenously-derived dsRNA. WO 01/70944, describes certain methods of drug screening using transgenic nematodes as Parkinson's Disease models using certain dsRNAs. WO 01/72774, describes certain *Drosophila*-derived gene products that may be related to RNAi in *Drosophila*. WO 01/75164 describes a *Drosophila* in vitro RNAi system and the use of specific siRNA molecules for certain functional genomic and certain therapeutic applications. The application reveals certain requirements for siRNA length, structure, chemical composition, and sequence that are essential to mediate efficient RNAi activity. These studies have shown that 21-nucleotide siRNA duplexes are most active when containing 3'-terminal dinucleotide overhangs.

WO 01/92513 describes certain methods for mediating gene suppression by using factors that enhance RNAi. WO 02/38805, describes certain *C. elegans* genes identified via RNAi. WO 02/44321 discloses that double-stranded RNA (dsRNA) 19-23 nt in length induces sequence-specific post-transcriptional gene silencing in a *Drosophila* in vitro system. Short interfering RNAs (siRNAs) generated by an RNaseIII-like processing reaction from long dsRNA or chemically synthesized siRNA duplexes with overhanging 3' ends mediate efficient target RNA cleavage in the lysate, and the cleavage site is located near the center of the region spanned by the guiding siRNA. The PCT publication also provides evidence that the direction of dsRNA processing determines whether sense or antisense-identical target RNA can be cleaved by the produced siRNP complex. WO 02/55692, WO02/55693, and EP 1144623 describe certain methods for inhibiting gene expression using dsRNA. US 2002/0086356 discloses RNA interference (RNAi) in a *Drosophila* in vitro system using RNA segments 21-23 nucleotides (nt) in length. The patent application publication teaches that when these 21-23 nt fragments are purified and added back to *Drosophila* extracts, they mediate sequence-specific RNAi in the absence of long dsRNA. The patent application publication also teaches that chemically synthesized oligonucleotides of the same or similar nature can also be used to target specific mRNAs for degradation in mammalian cells. US 2002/016216 discloses a method for attenuating expression of a target gene in cultured cells by introducing double stranded RNA (dsRNA) that comprises a nucleotide sequence that hybridizes under stringent conditions to a nucleotide sequence of the target gene into the cells in an amount sufficient to attenuate expression of the target gene. WO 03/006477 discloses engineered RNA precursors that when expressed in a cell are processed by the cell to produce targeted small interfering RNAs (siRNAs) that selectively silence targeted genes (by cleaving specific mRNAs) using the cell's own RNA interference (RNAi) pathway. By introducing nucleic acid molecules that encode these engineered RNA precursors into cells in vivo with appropriate regulatory sequences, expression of the engineered RNA precursors can be selectively controlled both temporally and spatially, i.e., at particular times and/or in particular tissues, organs, or cells. WO 03/064626 and WO 03/064625 describe certain chemically modified dsRNA constructs. WO 03/070918 describes methods and reagents useful in modulating gene expression. Specifically, the application described double-stranded short interfering nucleic acids (siRNA) molecule that down-regulates expression of a target gene, wherein said siRNA molecule comprises no ribonucleotides and each strand of said double-stranded siRNA comprises about 21 nucleotides. WO 04/009779 discloses engineered miRNA precursor, which are designed to produce new miRNA targeting gene-of-interest. WO 04/66183 describes the invention relates to computational methods of identifying novel microRNA (miRNA) molecules and novel targets for miRNA molecules and the microRNA molecules and targets identified by such methods. US 2004/0268441 describes microRNA precursor constructs that can be designed to modulate expression of any nucleotide sequence of interest, either an endogenous plant gene or alternatively a transgene. WO 05/019453 describes a multifunctional siRNA molecules interact with a first and a second target nucleic acid sequence, methods and reagents useful in modulating gene expression. Specifically, the invention relates to synthetic chemically modified small nucleic acid molecules. WO 05/042705 discloses computer-assisted methods of identifying, designing and synthesizing siRNA nucleotide sequences for a target mRNA sequence of a target species. WO 05/042708 discloses a method for identifying siRNA target motifs in a transcript using a position-specific score matrix approach. The invention further provides a method for designing siRNAs with higher silencing efficacy and specificity. WO 05/044981 described compounds, compositions, and methods useful for modulating gene expression using short interfering nucleic acid (siRNA) molecules.

One of the major obstacles in various field of biotechnology is the difficulty to achieve parallel suppression or silencing of multiple genes in parallel. Procedures based on chimeric antisense molecules (WO 93/23551) are inefficient. Methods based on chimeric double-stranded RNA molecules (WO 03/078629) present an improvement, but the employed DNA constructs are still somewhat laborious to obtain. There is in consequence an unfulfilled need for efficient methods and compositions to achieve gene silencing in plants, especially for two and more target genes. This goal is achieved by the present invention.

SUMMARY OF THE INVENTION

A first embodiment of the invention relates to a method for silencing or attenuating expression of at least one target gene said method comprising introducing or expressing into said plant or a part thereof a chimeric ribonucleotide sequence comprising a modified ta-siRNA sequence, wherein in said sequence is modified in relation to a natural ta-siRNA sequence by at least replacing one phase region of said natural ta-siRNA by a sequence, which is substantially complementary to said target gene and which is heterologous with regard to said natural ta-siRNA.

The sequence, which is substantially complementary to said target gene, is substantially complementary to the non-transcribed and/or transcribed sequence of said target gene. The transcribed sequence includes but is not being limited to the intron(s), exon(s), 5'UTR and 3'UTR. The non-transcribed sequence of said target gene includes but is not being limited to promoter, enhancer, repressor, motif and modules for binding of regulatory elements. In case the sequence is substantially complementary to the non-transcribed sequence of the targe gene, ta-siRNA can target either the (+) or (−) strand of the gene.

Preferably, in addition to the replacement of one phase region, the microRNA binding site in said natural ta-siRNA sequence has also been replaced by another (heterogenous) sequence, which is—preferably—substantially complementary to a small RNA sequence. Said maII RNA sequence is preferably capable to recognize and mediate cleavage of other RNA sequences, and is more preferably selected from the group of microRNAs, and siRNAs present in a plant.

The person skilled in the art is aware of various ta-siRNAs which may be utilized for the present invention. Thus the natural ta-siRNA sequence used (either materially or as sequence information) as starting material for constructing a chimeric ribonucleotide sequence of the invention is preferably described by a sequence selected from the group consisting of a) the sequences described by SEQ ID NO: 1, 2, 3, 4, 5, 6, 7, 8, 9, 10, 11, 12, 13, 14, 15, 16, 17, 18, and/or 20, and
b) sequences having an identity of at least 60% to a sequence selected from the group consisting of the sequences described by SEQ ID NO: 1, 2, 3, 4, 5, 6, 7, 8, 9, 10, 11, 12, 13, 14, 15, 16, 17, 18, and/or 20, ands.
c) sequences hybridizing under conditions equivalent to binding or hybridization at 68° C. in a solution consisting of 5×SSPE, 1% SDS, 5×Denhardt's reagent and 100 μg/mL denatured salmon sperm DNA followed by washing in a solution comprising 1×SSC and 0.1% SDS at room temperature when a DNA probe of at least 100 nucleotides in length is employed to a sequences selected from the group consisting of the sequences described by SEQ ID NO: 1, 2, 3, 4, 5, 6, 7, 8, 9, 10, 11, 12, 13, 14, 15, 16, 17, 18, and/or 20 or a complement thereof.

Beside the modification described above (replacement of a phase region and—optionally—replacement of the micro-RNA binding site) other modifications (e.g., mutations; deletions, additions, etc.) can be made. Accordingly said modified ta-siRNA can be described by a sequences comprising at least one sequence selected from the group consisting of a) the sequences described by SEQ ID NO: 1, 2, 3, 4, 5, 6, 7, 8, 9, 10, 11, 12, 13, 14, 15, 16, 17, 18, and 20, and
b) a fragment consisting of at least 50 consecutive nucleotides of a sequences described by SEQ ID NO: 1, 2, 3, 4, 5, 6, 7, 8, 9, 10, 11, 12, 13, 14, 15, 16, 17, 18, and/or 20
c) sequences having an identity of at least 60% to a sequence selected from the group consisting of the sequences described by SEQ ID NO: 1, 2, 3, 4, 5, 6, 7, 8, 9, 10, 11, 12, 13, 14, 15, 16, 17, 18, and/or 20, and
d) sequences hybridizing under conditions equivalent to binding or hybridization at 68° C. in a solution consisting of 5×SSPE, 1% SDS, 5×Denhardt's reagent and 100 μg/mL denatured salmon sperm DNA followed by washing in a solution comprising 1×SSC and 0.1% SDS at room temperature when a DNA probe of at least 100 nucleotides in length is employed to a sequences selected from the group consisting of the sequences described by SEQ ID NO: 1, 2, 3, 4, 5, 6, 7, 8, 9, 10, 11, 12, 13, 14, 15, 16, 17, 18, and/or 20 or a complement thereof.

The person skilled in the art is aware of methods to identify the phase regions in a ta-siRNA molecule. For the specific ta-siRNA molecules disclosed herein the phase region of said ta-siRNA to be replaced is selected from the group consisting of a) (for the maize ta-siRNA described by SEQ ID NO: 1) a phase region from the group described by nucleotides 688 to 708, 667 to 687, 646 to 666, 625 to 645, 604 to 624, 583 to 603, 562 to 582 and/or 541 to 561 of SEQ ID NO: 1, and
b) (for the wheat ta-siRNA described by SEQ ID NO: 2) a phase region from the group described by nucleotides 585 to 605, 564 to 584, 543 to 563, 522 to 542 and/or 501 to 521 of SEQ ID NO: 2, and
c) (for the rice ta-siRNA described by SEQ ID NO: 3) a phase region from the group described by nucleotides 525 to 546, 504 to 524, 483 to 503, 462 to 482, 441 to 461, 420 to 440 and/or 399 to 419 of SEQ ID NO: 3, and
d) (for the cotton ta-siRNA TC31385 described by SEQ ID NO: 4) a phase region from the group described by nucleotides 591 to 612, 570 to 590, 549 to 569, 528 to 548, 507 to 527, 486 to 506, 465 to 485, and/or 444 to 464 of SEQ ID NO: 4, and
e) (for the soybean ta-siRNA TC228167 described by SEQ ID NO: 5) a phase region from the group described by nucleotides 595 to 616, 574 to 594, 553 to 573, 532 to 552, 511 to 531, 490 to 510, 469 to 489, and/or 448 to 468 of SEQ ID NO: 5, and
f) (for the Canola ta-siRNA 51296077 described by SEQ ID NO: 6) a phase region from the group described by nucleotides 396 to 416, 375 to 395, 354 to 374, 333 to 353, 312 to 332, 291 to 311, 270 to 290, and/or 249 to 269 of SEQ ID NO: 6, and
g) (for the sunflower ta-siRNA described by SEQ ID NO 7) a phase region from the group described by nucleotides 469 to 489, 448 to 468, 427 to 467, 406 to 426, 385 to 405, 364 to 384, 343 to 363, and/or 322 to 342 of SEQ ID NO: 7, and
h) (for barley ta-siRNA described by SEQ ID NO: 8) a phase region from the group described by nucleotides 482-503, 461-481, 440-460, 419-439 and/or 398-418 SEQ ID NO: 8, and
i) (for the tomato ta-siRNA described by SEQ ID NO: 9) a phase region from the group described by nucleotides 504 to 525, 483 to 503, 462 to 482, 441 to 461, 420 to 440, 399 to 419, 378 to 398, and/or 357 to 377 of SEQ ID NO: 9, and
j) (for the sorghum ta-siRNA described by SEQ ID NO 10) a phase region from the group described by nucleotides 510-531, 489-509, 468-488, 447-467, 426-446 and/or 405-425 of SEQ ID NO: 10, and
k) (for the spruce ta-siRNA described by SEQ ID NO: 11) a phase region from the group described by nucleotides 301 to 322, 280 to 300, 259 to 279, 238 to 258, 217 to 237, 196 to 216, 175 to 195, and/or 154 to 174 of SEQ ID NO: 11, and
l) (for the cocoa ta-siRNA described by SEQ ID NO: 12) a phase region from the group described by nucleotides 373 to 393, 352 to 372, 331 to 351, 310 to 330, 289 to 309, 268 to 288, 247 to 267, and/or 226 to 246 of SEQ ID NO: 12, and
m) (for the grape ta-siRNA described by SEQ ID NO: 13) a phase region from the group described by nucleotides 445 to 465, 424 to 444, 403 to 423, 382 to 402, 361 to 381, 340 to 360, 319 to 339, and/or 298 to 318 of SEQ ID NO: 13, and
n) (for the lotus ta-siRNA described by SEQ ID NO: 14) a phase region from the group described by nucleotides 203 to 224, 182 to 202, 161 to 181, 140 to 160, 119 to 139, 98 to 118, 77 to 97, and/or 56 to 76 of SEQ ID NO: 14, and
o) (for the *populus* ta-siRNA described by SEQ ID NO: 15) a phase region from the group described by nucleotides 1084 to 1105, 1063 to 1083, 1042 to 1062, 1021 to 1041, 1000 to 1020, 9799 to 999, 958 to 978 and/or 937 to 957 of SEQ ID NO: 15, and
p) (for the *Arabidopsis thaliana* ta-siRNA TAS1a described by SEQ ID NO: 16) a phase region from the group described by nucleotides 436 to 456, 457 to 477, 478 to 498, 499 to 519, 520 to 540, 541 to 561, 562 to 582 and/or 583 to 603 of SEQ ID NO: 16, and
q) (for the *Arabidopsis thaliana* ta-siRNA Arab TAS1b described by SEQ ID NO: 17) a phase region from the group described by nucleotides 592 to 612, 613 to 633, 634 to 654, 655 to 675, 676 to 696 and/or 697 to 717 of SEQ ID NO: 17, and
r) (for the *Arabidopsis thaliana* ta-siRNA Arab TAS1c described by SEQ ID NO: 18) a phase region from the group described by nucleotides 556 to 576, 577 to 597, 598 to 618, 619 to 639, 640 to 660 and/or 661 to 681 of SEQ ID NO: 18, and
s) (for the *Arabidopsis thaliana* ta-siRNA Arab TAS2 described by SEQ ID NO: 19) a phase region from the group described by nucleotides 226 to 246, 247 to 267, 268 to 288, 289 to 309, 310 to 330 and/or 331 to 351 of SEQ ID NO: 19, and
t) (for the *Arabidopsis thaliana* ta-siRNA Arab TAS3 described by SEQ ID NO: 20) a phase region from the group described by nucleotides 1013 to 1033, 992 to 1012, 971 to 991, 950 to 970, 929 to 949, 908 to 928, 887 to 907 and/or 866 to 886 of SEQ ID NO: 20.

The person skilled in the art is aware of methods to identify the microRNA binding sites in a ta-siRNA molecule. For the specific ta-siRNA molecules disclosed herein the microRNA binding site to be replaced is selected from the group consisting of a) the binding site described by nucleotide 698 to 718 of SEQ ID NO: 1, and
b) the binding site described by nucleotide 594 to 615 of SEQ ID NO: 2, and
c) the binding site described by nucleotide 536 to 556 of SEQ ID NO: 3, and
d) the binding site described by nucleotide 601 to 622 of SEQ ID NO: 4, and
e) the binding site described by nucleotide 605 to 626 of SEQ ID NO: 5, and
f) the binding site described by nucleotide 405 to 426 of SEQ ID NO: 6, and
g) the binding site described by nucleotide 478 to 499 of SEQ ID NO: 7, and
h) the binding site described by nucleotide 492 to 512 of SEQ ID NO: 8, and
i) the binding site described by nucleotide 514 to 535 of SEQ ID NO: 9, and
j) the binding site described by nucleotide 521 to 541 of SEQ ID NO: 10, and
k) the binding site described by nucleotide 311 to 332 of SEQ ID NO: 11, and
l) the binding site described by nucleotide 382 to 403 of SEQ ID NO: 12, and
m) the binding site described by nucleotide 454 to 475 of SEQ ID NO: 13, and
n) the binding site described by nucleotide 213 to 234 of SEQ ID NO: 14, and:
o) the binding site described by nucleotide 1094 to 1115 of SEQ ID NO: 15, and
p) the binding site described by nucleotide 424 to 445 of SEQ ID NO: 16, and
q) the binding site described by nucleotide 580 to 601 of SEQ ID NO: 17, and
r) the binding site described by nucleotide 544 to 565 of SEQ ID NO: 18, and
s) the binding site described by nucleotide 214 to 235 of SEQ ID NO: 19, and
t) the binding site described by nucleotide 1022 to 1043 of SEQ ID NO: 20

A broad variety of target genes can be modulated (e.g., silenced or attenuated) by using the method of the invention, including genes in a plant but also genes or plant infecting or eating pathogens, animals, or even human. Preferably, the target gene is selected from the group consisting of plant endogenes, transgenes, or genes from a plant infecting pathogen. More preferably the plant infecting pathogen is selected from the group consisting of viruses, fungi, bacteria, insects, and nematodes. In case of pathogens the target gene may for example be a housekeeping or other gene, which is essential for viability or proliferation of the pathogen. Thus the sequence incorporated into the ta-siRNA molecule (by replacement of a phase region) corresponds preferably to a target gene is selected from the group consisting of plant endogenes, transgenes, or genes from a plant infecting pathogen.

In case of pathogens the plant infecting pathogen is preferably selected from the group consisting of viruses, fungi, bacteria, insects, and nematodes.

By choice of either the promoter to direct expression of the chimeric ribonucleotide sequence of the invention, but also by choice of the sequence corresponding to a small RNA (e.g., microRNA sequence) for replacement of the natural microRNA binding site the profile of silencing can be modulated e.g., in a tissue or developmental specific way.

Preferably the sequence utilized to replace the natural microRNA binding site corresponds to a microRNA which is preferably selected from the group consisting of endogenous plant microRNAs and transgenic microRNAs. More preferably, the microRNA is tissue-specific expressed, spatially-regulated, developmentally regulated, and/or regulated by biotic or abiotic stress factors. Even more preferably, the microRNA is described by any of SEQ ID NO: 78, 79, 80, 84, 85, 86, 87, 88, 89, 90, 91, 92, 93, 94, 95, 96, 97, 98, 99, 100, 101, 102, 103, 104, 105, 106, 107, 108, 109, and/or 110 or the microRNA is derived from a precursor sequence, in particular from a precursor sequence of miR173 and/or miR390, e.g. the microRNA is derived from a sequence comprising Seq ID No. 210, 215, 216, 217, 218, 219, 220, 221, 222, and/or 223.

The person skilled in the art is aware that the binding site in the ta-siRNA molecule does not need to be absolutely complementary to the small RNA, e.g., the micro RNA). Thus, the sequence being substantially complementary to the microRNA has—preferably—an identity of at least 60% or not more than 6 mismatches over the its entire sequence in comparison to the complement of a microRNA sequence. More preferably, said mismatches are predominantly in the region corresponding to the 3'-region of said microRNA.

There are various ways to introduce the chimeric ribonucleotide sequence of the invention into a plant. For example the ribonucleotide sequence can be synthesized in vitro and directly introduced. However, it is preferred to introduce the ribonucleotide sequence by means of an expression construct from which the ribonucleotide sequence is expressed in vivo. Thus expression of said chimeric ribonucleotide sequence is preferably realized by using a DNA expression cassette, said expression cassette comprising a promoter sequence functional in a plant operably linked to a nucleotide sequence encoding said chimeric ribonucleotide sequence. More preferably said promoter is selected from the group consisting of constitutive promoters, tissue-specific or tissue-preferential promoters, and inducible promoters, developmentally regulated promoters, and promoters regulated by biotic or abiotic stress factors.

As mentioned above various target genes can by advantageously silenced by the method of the invention. Preferably, the silencing or attenuating said target gene results in an agronomic trait. More preferably, said agronomic trait is selected from the group consisting of disease resistance, herbicide resistance, resistance against biotic or abiotic stress, and improved nutritional value. The target gene can for example be selected from the group consisting of genes involved in the synthesis and/or degradation of proteins, peptides, fatty acids, lipids, waxes, oils, starches, sugars, carbohydrates, flavors, odors, toxins, carotenoids, hormones, polymers, flavonoids, storage proteins, phenolic acids, alkaloids, lignins, tannins, celluloses, glycoproteins, and glycolipids. All these sequences are well known to the person skilled in the art an can be easily obtained from DNA data bases (e.g., GenBank).

The chimeric ribonucleotide sequences provided herein a novel and inventive as such. Thus another embodiment of the invention relates to a chimeric ribonucleotide sequence, said chimeric ribonucleotide sequence comprising a modified ta-siRNA sequence, wherein in said sequence is modified in relation to a natural ta-siRNA sequence by at least replacing one phase region of said natural ta-siRNA by a sequence, which is substantially complementary to a target gene and which is heterologous with regard to said natural ta-siRNA.

The specific and preferred characteristics for said chimeric ribonucleotide sequence are described above for the method of the invention and apply in full scope also for the subject matter of said chimeric ribonucleotide sequences.

Preferably, the microRNA binding site in said natural ta-siRNA sequence has been replaced by a sequence, which is substantially complementary to a small RNA sequence, which is capable to recognize and mediate cleavage of other RNA sequences. More preferably, said small RNA is selected from the group of microRNAs, and siRNAs present in a plant. Preferred microRNAs to use for designing the replacement sequence are described above.

Other preferred feature of the chimeric ribonucleotide sequence such as a) the natural ta-siRNA sequence, and/or
b) the modified ta-siRNA sequence, and/or
c) the phase region of said ta-siRNA, and/or
d) the microRNA binding site to be replaced, as described above for the method of the invention.

The target gene is preferably selected from the group consisting of genes in a plant or of a plant infecting pathogen.

Another embodiment of the invention relates to deoxyribonucleotide sequences encoding a chimeric ribonucleotide sequence of the invention.

In one preferred embodiment of the invention, the chimeric ribonucleotide sequence is expressed from an expression construct. Thus another embodiment of the invention relates to an expression construct comprising a promoter sequence functional in a plant functionally linked thereto a nucleotide sequence encoding a chimeric ribonucleotide sequence as described above. The promoter operably linked to the sequence encoding the chimeric ribonucleotide sequence is preferably selected from the group consisting of constitutive promoters, tissue-specific or tissue-preferential promoters, and inducible promoters, developmentally regulated promoters, and promoters regulated by biotic or abiotic stress factors.

Yet another embodiment of the invention relates to an expression vector comprising an expression construct of the invention. Preferably, the expression vector is a eukaryotic expression vector, a viral vector, a plasmid vector or a binary vector.

Another embodiment of the invention relates to a transformed cell or a non-human organism comprising a sequence (e.g., a chimeric ribonucleotide sequence or a DNA sequence encoding said sequence), an expression construct or an expression vector of the invention. Preferably, the transformed cell or non-human organism comprises said expression construct or expression vector inserted into its genome. More preferably, the transformed cell or non-human organism is selected from the group of mammalian, bacterial, fungal, nematode or plant cells and organism. Most preferably, the transformed cell or non-human organism is selected from the group of monocotyledonous and dicotyledonous plants. Additional embodiments of the invention relate to transformed seeds and plants of the plant of the inventions and the use of said plants, seeds, and plant parts in the agro-industry and/or in the production of food, feed, industrial products, oil, nutrients, and other valuable products. Preferably, these other embodiment of the invention relates to a) transformed seed of such a plant,
b) a method for breeding other plants using said plant,
c) use of said plant in breeding or agriculture,
d) use of said plant to produce chemicals, food or feed products.

In further embodiments, the present invention relates to an expression construct comprising the Seq ID. No.: 210, 215, 216, 217, 218, 219, 220, 221, 222, and/or 223 or derivate thereof, the use of Seq ID No.: 210, 215, 216, 217, 218, 219, 220, 221, 222, and/or 223 or a derivate thereof to express a microRNA, e.g. the use of Seq ID No.: 210, 215, 216, 217, 218, 219, 220, 221, 222, and/or 223 to express miR390 or derivate thereof.

DEFINITIONS

Abbreviations: BAP—6-benzylaminopurine; 2,4-D-2,4-dichlorophenoxyacetic acid; MS-Mura-shige and Skoog medium; NAA-1-naphtaleneacetic acid; MES, 2-(N-morpholino-ethanesulfonic acid, IAA indole acetic acid; Kan: Kanamycin sulfate; GA3-Gibberellic acid; Timentin™: ticarcillin disodium/clavulanate potassium.

It is to be understood that this invention is not limited to the particular methodology, protocols, cell lines, plant species or genera, constructs, and reagents described as such. It is also to be understood that the terminology used herein is for the purpose of describing particular embodiments only, and is not intended to limit the scope of the present invention which will be limited only by the appended claims. It must be noted that as used herein and in the appended claims, the singular forms "a," "and," and "the" include plural reference unless the context clearly dictates otherwise. Thus, for example, reference to "a vector" is a reference to one or more vectors and includes equivalents thereof known to those skilled in the art, and so forth. The term "about" is used herein to mean approximately, roughly, around, or in the region of. When the term "about" is used in conjunction with a numerical range, it modifies that range by extending the boundaries above and below the numerical values set forth. In general, the term "about" is used herein to modify a numerical value above and below the stated value by a variance of 20 percent, preferably 10 percent up or down (higher or lower). As used herein, the word "or" means any one member of a particular list and also includes any combination of members of that list. The words "comprise," "comprising," "include," "including," and "includes" when used in this specification and in the following claims are intended to specify the presence of one or more stated features, integers, components, or steps, but they do not preclude the presence or addition of one or more other features, integers, components, steps, or groups thereof. For clarity, certain terms used in the specification are defined and used as follows:

Agronomically valuable trait: The term "agronomically valuable trait" refers to any phenotype in a plant organism that is useful or advantageous for food production or food products, including plant parts and plant products. Non-food agricultural products such as paper, etc. are also included. A partial list of agronomically valuable traits includes pest resistance, vigor, development time (time to harvest), enhanced nutrient content, novel growth patterns, flavors or colors, salt, heat, drought and cold tolerance, and the like. Preferably, agronomically valuable traits do not include selectable marker genes (e.g., genes encoding herbicide or antibiotic resistance used only to facilitate detection or selection of transformed cells), hormone biosynthesis genes leading to the production of a plant hormone (e.g., auxins, gibberllins, cytokinins, abscisic acid and ethylene that are used only for selection), or reporter genes (e.g. luciferase, glucuronidase, chloramphenicol acetyl transferase (CAT, etc.). Such agronomically valuable important traits may include improvement of pest resistance (e.g., Melchers et al. (2000) Curr Opin Plant Biol 3(2):147-52), vigor, development time (time to harvest), enhanced nutrient content, novel growth patterns, flavors or colors, salt, heat, drought, and cold tolerance (e.g., Sakamoto et al. (2000) J Exp Bot 51(342):81-8; Saijo et al. (2000) Plant J 23(3): 319-327; Yeo et al. (2000) Mol Cells 10(3):263-8; Cushman et al. (2000) Curr Opin Plant Biol 3(2):117-24), and the like. Those of skill will recognize that there are numerous polynucleotides from which to choose to confer these and other agronomically valuable traits.

Alter: To "alter" or "modulate" the expression of a nucleotide sequence in a cell (e.g., a plant cell) means that the level of expression of the nucleotide sequence in a cell after applying a method of the present invention is different from its expression in the cell before applying the method. In a preferred embodiment, to alter expression means that the expression of the nucleotide sequence in the plant is reduced after applying a method of the present invention as compared to before applying the method. "Reduction of" or "to reduce" the expression of a target gene is to be understood in the broad sense and comprises the partial or essentially complete prevention or blocking of the expression of the target gene or the RNA, mRNA, rRNA, tRNA derived therefrom and/or of the protein product encoded by it in a cell, an organism or a part, tissue, organ, cell or seed thereof, which prevention or blockage may be based on different cell-biological mechanisms. The term "reduced" means herein lower, preferably significantly lower, more preferably the expression of the nucleotide sequence is not detectable. As used herein, "a reduction" of the level of an agent such as a protein or mRNA means that the level is reduced relative to a cell or organism lacking a chimeric RNA molecule of the invention capable of reducing the agent. As used herein, "at least a partial reduction" of the level of an agent (such as a RNA, mRNA, rRNA, tRNA expressed by the target gene and/or of the protein product encoded by it) means that the level is reduced at least 25%, preferably at least 50%, relative to a cell or organism lacking a chimeric RNA molecule of the invention capable of reducing said agent. As used herein, "a substantial reduction" of the level of an agent such as a protein or mRNA means that the level is reduced relative to a cell or organism lacking a chimeric RNA molecule of the invention capable of reducing the agent, where the reduction of the level of the agent is at least 75%, preferably at least 85%. As used herein, "an effective elimination" of an agent such as a protein or mRNA is relative to a cell or organism lacking a chimeric RNA molecule of the invention capable of reducing the agent, where the reduction of the level of the agent is greater than 95%, preferably greater than 98%. The reduction can be determined by methods with which the skilled worker is familiar. Thus, the reduction of the protein quantity can be determined for example by an immunological detection of the protein. Moreover, biochemical techniques such as Northern hybridization, nuclease protection assay, reverse transcription (quantitative RT-PCR), ELISA (enzyme-linked immunosorbent assay), Western blotting, radioimmunoassay (RIA) or other immunoassays and fluorescence-activated cell analysis (FACS) can be employed. Depending on the type of the reduced protein product, its activity or the effect on the phenotype of the organism or the cell may also be determined. Methods for determining the protein quantity are known to the skilled worker. Examples, which may be mentioned, are: the micro-Biuret method (Goa J (1953) Scand J Clin Lab Invest 5:218-222), the Folin-Ciocalteau method (Lowry O H et al. (1951) J Biol Chem 193:265-275) or measuring the absorption of CBB G-250 (Bradford M M (1976) Analyt Biochem 72:248-254). In another preferred embodiment, to alter expression means that the expression of the nucleotide sequence in the plant is increased after applying a method of the present invention as compared to before applying the method.

Amino acid sequence: As used herein, the term "amino acid sequence" refers to a list of abbreviations, letters, characters or words representing amino acid residues. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

Animal: The terms "animal" or "animal organism" refer to nonhuman vertebrates or invertebrates. Preferred vertebrates comprise, for example, fish species, nonhuman mammals such as cattle, horse, sheep, goat, mouse, rat or pig, and birds such as chicken or goose. Preferred animal cells comprise CHO, COS, HEK293 cells. Invertebrates comprise nematodes or other worms, and insects. Invertebrates comprise insect cells such as *Drosophila* S2 and *Spodoptera* Sf9 or Sf21 cells. Furthermore preferred are nematodes, which are capable of attacking animals or humans, such as those of the genera *Ancylostoma, Ascaridia, Ascaris, Bunostomum, Caenorhabditis, Capillaria, Chabertia, Cooperia, Dictyocaulus, Haemonchus, Heterakis, Nematodirus, Oesophagostomum, Ostertagia, Oxyuris, Parascaris, Strongylus, Toxascaris, Trichuris, Trichostrongylus, Tfhchonema, Toxocara* or *Uncinaria*. Furthermore preferred are those which are capable of attacking plant organisms such as, for example, *Bursaphalenchus, Criconemella, Diiylenchus, Ditylenchus, Globodera, Helicotylenchus, Heterodera, Longidorus, Melodoigyne, Nacobbus, Paratylenchus, Pratylenchus, Radopholus, Rotelynchus, Tylenchus* or *Xiphinema*. Preferred insects comprise those of the genera Coleoptera, Diptera, Lepidoptera and Homoptera.

Antiparallel: "Antiparallel" refers herein to two nucleotide sequences paired through hydrogen bonds between complementary base residues with phosphodiester bonds running in the 5'-3' direction in one nucleotide sequence and in the 3'-5' direction in the other nucleotide sequence.

Antisense: The term "antisense" refers to a nucleotide sequence that is inverted relative to its normal orientation for transcription and so expresses an RNA transcript that is complementary to a target gene mRNA molecule expressed within the host cell (e.g., it can hybridize to the target gene mRNA molecule through Watson-Crick base pairing). An antisense strand may be constructed in a number of different ways, provided that it is capable of interfering with the expression of a target gene. For example, the antisense strand can be constructed by inverting the coding region (or a portion thereof) of the target gene relative to its normal orientation for transcription to allow the transcription of its complement, (e.g., RNAs encoded by the antisense and sense gene may be complementary). Furthermore, the antisense oligonucleotide strand need not have the same intron or exon pattern as the target gene, and noncoding segments of the target gene may be equally effective in achieving antisense suppression of target gene expression as coding segments. In the context of gene silencing the term "antisense" is understood to mean a nucleic acid having a sequence complementary to a target sequence, for example a messenger RNA (mRNA) sequence the blocking of whose expression is sought to be initiated by hybridization with the target sequence.

Cell: The term "cell" or "plant cell" as used herein refers preferably to a single cell. The term "cells" refers to a population of cells. The population may be a pure population comprising one cell type. Likewise, the population may comprise more than one cell type. In the present invention, there is no limit on the number of cell types that a cell population may comprise. The cells may be synchronized or not synchronized. A cell within the meaning of this invention may be isolated (e.g., in suspension culture) or comprised in a tissue, organ or organism at any developmental stage.

Coding region: As used herein the term "coding region" when used in reference to a structural gene refers to the nucleotide sequences which encode the amino acids found in the nascent polypeptide as a result of translation of a mRNA molecule. The coding region is bounded, in eukaryotes, on the 5'-side by the nucleotide triplet "ATG" which encodes the initiator methionine and on the 3'-side by one of the three triplets which specify stop codons (i.e., TAA, TAG, TGA). In addition to containing introns, genomic forms of a gene may also include sequences located on both the 5'- and 3'-end of the sequences which are present on the RNA transcript. These sequences are referred to as "flanking" sequences or regions (these flanking sequences are located 5' or 3' to the non-translated sequences present on the mRNA transcript). The 5'-flanking region may contain regulatory sequences such as promoters and enhancers which control or influence the transcription of the gene. The 3'-flanking region may contain sequences which direct the termination of transcription, post-transcriptional cleavage and polyadenylation.

Complementary: "Complementary" or "complementarity" refers to two nucleotide sequences which comprise antiparallel nucleotide sequences capable of pairing with one another (by the base-pairing rules) upon formation of hydrogen bonds between the complementary base residues in the antiparallel nucleotide sequences. For example, the sequence 5'-AGT-3' is complementary to the sequence 5'-ACT-3'. Complementarity can be "partial" or "total." "Partial" complementarity is where one or more nucleic acid bases is not matched according to the base pairing rules. "Total" or "complete" complementarity between nucleic acids is where each and every nucleic acid base is matched with another base under the base pairing rules. The degree of complementarity between nucleic acid strands has significant effects on the efficiency and strength of hybridization between nucleic acid strands. A "complement" of a nucleic acid sequence as used herein refers to a nucleotide sequence whose nucleic acids show total complementarity to the nucleic acids of the nucleic acid sequence.

Chromosomal DNA: The term "chromosomal DNA" or "chromosomal DNA-sequence" is to be understood as the genomic DNA of the cellular nucleus independent from the cell cycle status. Chromosomal DNA might therefore be organized in chromosomes or chromatids, they might be condensed or uncoiled. An insertion into the chromosomal DNA can be demonstrated and analyzed by various methods known in the art like e.g., polymerase chain reaction (PCR) analysis, Southern blot analysis, fluorescence in situ hybridization (FISH), and in situ PCR.

DNA shuffling: DNA shuffling is a method to rapidly, easily and efficiently introduce mutations or rearrangements, preferably randomly, in a DNA molecule or to generate exchanges of DNA sequences between two or more DNA molecules, preferably randomly. The DNA molecule resulting from DNA shuffling is a shuffled DNA molecule that is a non-naturally occurring DNA molecule derived from at least one template DNA molecule. The shuffled DNA encodes an enzyme modified with respect to the enzyme encoded by the template DNA, and preferably has an altered biological activity with respect to the enzyme encoded by the template DNA.

Double-stranded RNA: A "double-stranded RNA" molecule, "RNAi molecule", or "dsRNA" molecule comprises a sense RNA fragment of a nucleotide sequence and an antisense RNA fragment of the nucleotide sequence, which both comprise nucleotide sequences complementary to one another, thereby allowing the sense and antisense RNA fragments to pair and form a double-stranded RNA molecule. Preferably the terms refer to a double-stranded RNA molecule capable, when introduced into a cell or organism, of at least partially reducing the level of an mRNA species present in a cell or a cell of an organism. As used herein, "RNA interference", "RNAi, and "dsRNAi" refer to gene-specific silencing that is induced by the introduction of a double-stranded RNA molecule.

Endogenous: An "endogenous" nucleotide sequence refers to a nucleotide sequence, which is present in the genome of the untransformed cell (e.g., a plant or mammalian cell).

Essential: An "essential" gene is a gene encoding a protein such as e.g. a biosynthetic enzyme, receptor, signal transduction protein, structural gene product, or transport protein that is essential to the growth or survival of the organism or cell (e.g., a plant).

Exon: The term "exon" as used herein refers to the normal sense of the term as meaning a segment of nucleic acid molecules, usually DNA, that encodes part of or all of an expressed protein.

Expression: "Expression" refers to the biosynthesis of a gene product, preferably to the transcription and/or translation of a nucleotide sequence, for example an endogenous gene or a heterologous gene, in a cell. For example, in the case of a structural gene, expression involves transcription of the structural gene into mRNA and—optionally—the subsequent translation of mRNA into one or more polypeptides. In the case of antisense constructs, for example, expression may refer to the transcription of the antisense DNA only.

Expression construct/expression construct: "Expression construct" and "expression construct" as used herein are synonyms and mean a DNA sequence capable of directing expression of a particular nucleotide sequence in an appropriate host cell (e.g., a plant pr mammalian cell), comprising a promoter functional in said host cell into which it will be introduced, operatively linked to the nucleotide sequence of interest which is—optionally—operatively linked to termination signals. If translation is required, it also typically comprises sequences required for proper translation of the nucleotide sequence. The coding region may code for a protein of interest but may also code for a functional RNA of interest, for example antisense RNA, dsRNA, or a nontranslated RNA, in the sense or antisense direction. The expression construct comprising the nucleotide sequence of interest may be chimeric, meaning that at least one of its components is heterologous with respect to at least one of its other components. The expression construct may also be one, which is naturally occurring but has been obtained in a recombinant form useful for heterologous expression. Typically, however, the expression construct is heterologous with respect to the host, i.e., the particular DNA sequence of the expression construct does not occur naturally in the host cell and must have been introduced into the host cell or an ancestor of the host cell by a transformation event. The expression of the nucleotide sequence in the expression construct may be under the control of a constitutive promoter or of an inducible promoter, which initiates transcription only when the host cell is exposed to some particular external stimulus. In the case of a multicellular organism, such as a plant, the promoter can also be specific to a particular tissue or organ or stage of development.

Foreign: The term "foreign" refers to any nucleic acid (e.g., gene sequence) which is introduced into the genome of a cell by experimental manipulations and may include sequences found in that cell so long as the introduced sequence contains some modification (e.g., a point mutation, the presence of a selectable marker gene, etc.) relative to the naturally-occurring sequence.

Gene: The term "gene" refers to a coding region operably joined to appropriate regulatory sequences capable of regulating the expression of the gene product (e.g., a polypeptide or a functional RNA) in some manner. A gene includes untranslated regulatory regions of DNA (e.g., promoters, enhancers, repressors, etc.) preceding (up-stream) and following (downstream) the coding region (open reading frame, ORF) as well as, where applicable, intervening sequences (i.e., introns) between individual coding regions (i.e., exons). The term "structural gene" as used herein is intended to mean a DNA sequence that is transcribed into mRNA which is then translated into a sequence of amino acids characteristic of a specific polypeptide.

Genetically-modified organism: The term "genetically-modified organism" or "GMO" refers to any organism that comprises heterologous DNA or a transgene. Exemplary organisms include plants, animals and microorganisms.

Genome and genomic DNA: The terms "genome" or "genomic DNA" is referring to the heritable genetic information of a host organism. Said genomic DNA comprises the DNA of the nucleus (also referred to as chromosomal DNA) but also the DNA of the plastids (e.g., chloroplasts) and other cellular organelles (e.g., mitochondria). Preferably the terms genome or genomic DNA is referring to the chromosomal DNA of the nucleus.

Hairpin RNA: As used herein "hairpin RNA" refers to any self-annealing double stranded RNA molecule. In its simplest representation, a hairpin RNA consists of a double stranded stem made up by the annealing RNA strands, connected by a single stranded RNA loop, and is also referred to as a "pan-handle RNA". However, the term "hairpin RNA" is also intended to encompass more complicated secondary RNA structures comprising self-annealing double stranded RNA sequences, but also internal bulges and loops. The specific secondary structure adapted will be determined by the free energy of the RNA molecule, and can be predicted for different situations using appropriate software such as FOLDRNA (Zuker and Stiegler (1981) Nucleic Acids Res 9(1):133-48; Zuker, M. (1989) Methods Enzymol. 180:262-288).

Heterologous: The terms "heterologous" with respect to a nucleic acid or DNA refer to a nucleotide sequence which is ligated to, or is manipulated to become ligated to, a nucleic acid sequence to which it is not ligated in nature, or to which it is ligated at a different location in nature. A heterologous expression construct comprising a nucleic acid sequence and at least one regulatory sequence (such as an promoter or an transcription termination signal) linked thereto for example is a constructs originating by experimental manipulations in which either a) said nucleic acid sequence, or b) said regulatory sequence or c) both (i.e. (a) and (b)) is not located in its natural (native) genetic environment or has been modified by experimental manipulations, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1,000 bp, very especially preferably at least 5,000 bp, in length. A naturally occurring expression construct—for example the naturally occurring combination of a promoter with the corresponding gene—becomes a transgenic expression construct when it is modified by non-natural, synthetic "artificial" methods such as, for example, mutagenization. Such methods have been described (U.S. Pat. No. 5,565,350; WO 00/15815). For example a protein encoding nucleic acid sequence operably lined to a promoter, which is not the native promoter of this sequence, is considered to be heterologous with respect to the promoter. Preferably, heterologous DNA is not endogenous to or not naturally associated with the cell into which it is introduced, but has been obtained from another cell. Heterologous DNA also includes an endogenous DNA sequence, which contains some modification, non-naturally occurring multiple copies of a endogenous DNA sequence, or a DNA sequence which is not naturally associated with another DNA sequence physically linked thereto. Generally, although not necessarily, heterologous DNA encodes RNA and proteins that are not normally produced by the cell into which it is expressed.

Homologous DNA Sequence: a DNA sequence naturally associated with a host cell or another DNA sequence.

Hybridization: The term "hybridization" as used herein includes "any process by which a strand of nucleic acid joins with a complementary strand through base pairing." (J. Coombs (1994) Dictionary of Biotechnology, Stockton Press, New York). Hybridization and the strength of hybridization (i.e., the strength of the association between the nucleic acids) is impacted by such factors as the degree of complementarity between the nucleic acids, stringency of the conditions involved, the Tm of the formed hybrid, and the G:C ratio within the nucleic acids. As used herein, the term "Tm" is used in reference to the "melting temperature." The melting temperature is the temperature at which a population of double-stranded nucleic acid molecules becomes half dissociated into single strands. The equation for calculating the Tm of nucleic acids is well known in the art. As indicated by standard references, a simple estimate of the Tm value may be calculated by the equation: Tm=81.5+0.41(% G+C), when a nucleic acid is in aqueous solution at 1M NaCl [see e.g., Anderson and Young, Quantitative Filter Hybridization, in Nucleic Acid Hybridization (1985)]. Other references include more sophisticated computations, which take structural as well as sequence characteristics into account for the calculation of Tm. Stringent conditions, are known to those skilled in the art and can be found in Current Protocols in Molecular Biology, John Wiley & Sons, N.Y. (1989), 6.3.1-6.3.6.

Low stringency conditions when used in reference to nucleic acid hybridization comprise conditions equivalent to binding or hybridization at 68° C. in a solution consisting of 5×SSPE (43.8 g/L NaCl, 6.9 g/L $NaH_2PO_4.H_2O$ and 1.85 g/L EDTA, pH adjusted to 7.4 with NaOH), 1% SDS, 5×Denhardt's reagent [50×Denhardt's contains the following per 500 mL 5 g Ficoll (Type 400, Pharmacia), 5 g BSA (Fraction V; Sigma)] and 100 μg/mL denatured salmon sperm DNA followed by washing (preferably for one times 15 minutes, more preferably two times 15 minutes, more preferably three time 15 minutes) in a solution comprising 1×SSC (1×SSC is 0.15 M NaCl plus 0.015 M sodium citrate) and 0.1% SDS at room temperature or—preferably 37° C.—when a DNA probe of preferably about 100 to about 1,000 nucleotides in length is employed.

Medium stringency conditions when used in reference to nucleic acid hybridization comprise conditions equivalent to binding or hybridization at 68° C. in a solution consisting of 5×SSPE (43.8 g/L NaCl, 6.9 g/L $NaH_2PO_4.H_2O$ and 1.85 g/L EDTA, pH adjusted to 7.4 with NaOH), 1% SDS, 5×Denhardt's reagent [50×Denhardt's contains the following per 500 mL 5 g Ficoll (Type 400, Pharmacia), 5 g BSA (Fraction V; Sigma)] and 100 μg/mL denatured salmon sperm DNA followed by washing (preferably for one times 15 minutes, more preferably two times 15 minutes, more preferably three time 15 minutes) in a solution comprising 0.1×SSC (1×SSC is 0.15 M NaCl plus 0.015 M sodium citrate) and 1% SDS at room temperature or—preferably 37° C.—when a DNA probe of preferably about 100 to about 1,000 nucleotides in length is employed.

High stringency conditions when used in reference to nucleic acid hybridization comprise conditions equivalent to binding or hybridization at 68° C. in a solution consisting of 5×SSPE, 1% SDS, 5×Denhardt's reagent and 100 μg/mL denatured salmon sperm DNA followed by washing (preferably for one times 15 minutes, more preferably two times 15 minutes, more preferably three time 15 minutes) in a solution comprising 0.1×SSC, and 1% SDS at 68° C., when a probe of preferably about 100 to about 1,000 nucleotides in length is employed.

The term "equivalent" when made in reference to a hybridization condition as it relates to a hybridization condition of interest means that the hybridization condition and the hybridization condition of interest result in hybridization of nucleic acid sequences which have the same range of percent (%) homology. For example, if a hybridization condition of interest results in hybridization of a first nucleic acid sequence with other nucleic acid sequences that have from 80% to 90% homology to the first nucleic acid sequence, then another hybridization condition is said to be equivalent to the hybridization condition of interest if this other hybridization condition also results in hybridization of the first nucleic acid sequence with the other nucleic acid sequences that have from 80% to 90% homology to the first nucleic acid sequence. When used in reference to nucleic acid hybridization the art knows well that numerous equivalent conditions may be employed to comprise either low or high stringency conditions; factors such as the length and nature (DNA, RNA, base composition) of the probe and nature of the target (DNA, RNA, base composition, present in solution or immobilized, etc.) and the concentration of the salts and other components (e.g., the presence or absence of formamide, dextran sulfate, polyethylene glycol) are considered and the hybridization solution may be varied to generate conditions of either low or high stringency hybridization different from, but equivalent to, the above-listed conditions. Those skilled in the art know that whereas higher stringencies may be preferred to reduce or eliminate nonspecific binding, lower stringencies may be preferred to detect a larger number of nucleic acid sequences having different homologies.

"Identity": The term "identity" is a relationship between two or more polypeptide sequences or two or more nucleic acid molecule sequences, as determined by comparing the sequences. In the art, "identity" also means the degree of sequence relatedness between polypeptide or nucleic acid molecule sequences, as determined by the match between strings of such sequences. "Identity" as used herein can be measured between nucleic acid sequences of the same ribonucleic-type (such as between DNA and DNA sequences) or between different types (such as between RNA and DNA sequences). It should be understood that in comparing an RNA sequence to a DNA sequence, an "identical" RNA sequence will contain ribonucleotides where the DNA sequence contains deoxyribonucleotides, and further that the RNA sequence will contain a uracil at positions where the DNA sequence contains thymidine. In case an identity is measured between RNA and DNA sequences, uracil bases of RNA sequences are considered to be identical to thymidine bases of DNA sequences. "Identity" can be readily calculated by known methods including, but not limited to, those described in Computational Molecular Biology, Lesk, A. M., ed., Oxford University Press, New York (1988); Biocomputing: Informatics and Genome Projects, Smith, D. W., ed., Academic Press, New York, 1993; Computer Analysis of Sequence Data, Part I, Griffin, A. M. and Griffin, H. G., eds., Humana Press, New Jersey (1994); Sequence Analysis in Molecular Biology, von Heinje, G., Academic Press (1987); Sequence Analysis Primer, Gribskov, M. and Devereux, J., eds., Stockton Press, New York (1991); and Carillo, H., and Lipman, D., SIAM J. Applied Math, 48:1073 (1988). Methods to determine identity are designed to give the largest match between the sequences tested. Moreover, methods to determine identity are codified in publicly available programs. Computer programs which can be used to determine identity between two sequences include, but are not limited to, GCG (Devereux, J., et al., Nucleic Acids Research 12(1):387 (1984); suite of five BLAST programs, three designed for nucleotide sequences queries (BLASTN, BLASTX, and TBLASTX) and two designed for protein sequence queries (BLASTP and TBLASTN) (Coulson, Trends in Biotechnology, 12:76-80 (1994); Birren et al., Genome Analysis, 1:543-559 (1997)). The BLASTX program is publicly available from NCBI and other sources (BLAST Manual, Altschul, S., et al., NCBI NLM NIH, Bethesda, Md. 20894; Altschul, S., et al., J. Mol. Biol., 215:403-410 (1990)). The well-known Smith Waterman algorithm can also be used to determine identity. Parameters for polypeptide sequence comparison typically include the following:

Algorithm: Needleman and Wunsch, J. Mol. Biol., 48:443-453 (1970)

Comparison matrix: BLOSUM62 from Hentikoff and Hentikoff, Proc. Natl. Acad. Sci. USA, 89:10915-10919 (1992)

Gap Penalty: 12

Gap Length Penalty: 4

A program, which can be used with these parameters, is publicly available as the "gap" program from Genetics Computer Group, Madison, Wis. The above parameters along with no penalty for end gap are the default parameters for peptide comparisons. Parameters for nucleic acid molecule sequence comparison include the following:

Algorithm: Needleman and Wunsch, J. Mol. Bio. 48:443-453 (1970)

Comparison matrix: matches-+10; mismatches=0

Gap Penalty: 50

Gap Length Penalty: 3

As used herein, "% identity" is determined using the above parameters as the default parameters for nucleic acid molecule sequence comparisons and the "gap" program from GCG, version 10.2.

Infecting: The terms "infecting" and "infection" with a bacterium or virus refer to co-incubation of a target biological sample, (e.g., cell, tissue, etc.) with the bacterium or virus under conditions such that nucleic acid sequences contained within the bacterium or virus are introduced into one or more cells of the target biological sample.

Intron: The term "intron" as used herein refers to the normal sense of the term as meaning a segment of nucleic acid molecules, usually DNA, that does not encode part of or all of an expressed protein, and which, in endogenous conditions, is transcribed into RNA molecules, but which is spliced out of the endogenous RNA before the RNA is translated into a protein. The splicing, i.e., intron removal, occurs at a defined splice site, e.g., typically at least about 4 nucleotides, between cDNA and intron sequence. For example, without limitation, the sense and antisense intron segments illustrated herein, which form a double-stranded RNA contained no splice sites.

Isogenic: organisms (e.g., plants), which are genetically identical, except that they may differ by the presence or absence of a heterologous DNA sequence.

Isolated: The term "isolated" as used herein means that a material has been removed by the hand of man and exists apart from its original, native environment and is therefore not a product of nature. An isolated material or molecule (such as a DNA molecule or enzyme) may exist in a purified form or may exist in a non-native environment such as, for example, in a transgenic host cell. For example, a naturally occurring polynucleotide or polypeptide present in a living animal is not isolated, but the same polynucleotide or polypeptide, separated from some or all of the coexisting materials in the natural system, is isolated. Such polynucleotides can be part of a vector and/or such polynucleotides or polypeptides could be part of a composition, and would be isolated in that such a vector or composition is not part of its original environment. Preferably, the term "isolated" when used in relation to a nucleic acid, as in "an isolated nucleic acid sequence" refers to a nucleic acid sequence that is identified and separated from at least one contaminant nucleic acid with which it is ordinarily associated in its natural source. Isolated nucleic acid is nucleic acid present in a form or setting that is different from that in which it is found in nature. In contrast, non-isolated nucleic acids are nucleic acids such as DNA and RNA, which are found in the state they exist in nature. For example, a given DNA sequence (e.g., a gene) is found on the host cell chromosome in proximity to neighboring genes; RNA sequences, such as a specific mRNA sequence encoding a specific protein, are found in the cell as a mixture with numerous other mRNAs, which encode a multitude of proteins. However, an isolated nucleic acid sequence comprising for example SEQ ID NO: 1 includes, by way of example, such nucleic acid sequences in cells which ordinarily contain SEQ ID NO:1 where the nucleic acid sequence is in a chromosomal or extrachromosomal location different from that of natural cells, or is otherwise flanked by a different nucleic acid sequence than that found in nature. The isolated nucleic acid sequence may be present in single-stranded or double-stranded form. When an isolated nucleic acid sequence is to be utilized to express a protein, the nucleic acid sequence will contain at a minimum at least a portion of the sense or coding strand (i.e., the nucleic acid sequence may be single-stranded). Alternatively, it may contain both the sense and anti-sense strands (i.e., the nucleic acid sequence may be double-stranded).

Mammal: The terms "mammal" or "mammalian" are intended to encompass their normal meaning. While the invention is most desirably intended for efficacy in humans, it may also be employed in domestic mammals such as canines, felines, and equines, as well as in mammals of particular interest, e.g., zoo animals, farmstock and the like.

Mature protein: protein which is normally targeted to a cellular organelle, such as a chloroplast, and from which the transit peptide has been removed.

Minimal Promoter: promoter elements, particularly a TATA element, that are inactive or that have greatly reduced promoter activity in the absence of upstream activation. In the presence of a suitable transcription factor, the minimal promoter functions to permit transcription.

Non-coding: The term "non-coding" refers to sequences of nucleic acid molecules that do not encode part or all of an expressed protein. Non-coding sequences include but are not limited to introns, promoter regions, 3' untranslated regions, and 5' untranslated regions.

Nucleic acids and nucleotides: The terms "Nucleic Acids" and "Nucleotides" refer to naturally occurring or synthetic or artificial nucleic acid or nucleotides. The terms "nucleic acids" and "nucleotides" comprise deoxyribonucleotides or ribonucleotides or any nucleotide analogue and polymers or hybrids thereof in either single- or double-stranded, sense or antisense form. Unless otherwise indicated, a particular nucleic acid sequence also implicitly encompasses conservatively modified variants thereof (e.g., degenerate codon substitutions) and complementary sequences, as well as the sequence explicitly indicated. The term "nucleic acid" is used inter-changeably herein with "gene", "cDNA, "mRNA", "oligonucleotide," and "polynucleotide". Nucleotide analogues include nucleotides having modifications in the chemical structure of the base, sugar and/or phosphate, including, but not limited to, 5-position pyrimidine modifications, 8-position purine modifications, modifications at cytosine exocyclic amines, substitution of 5-bromo-uracil, and the like; and 2'-position sugar modifications, including but not limited to, sugar-modified ribonucleotides in which the 2'-OH is replaced by a group selected from H, OR, R, halo, SH, SR, NH2, NHR, NR2, or CN. Short hairpin RNAs (shRNAs) also can comprise non-natural elements such as non-natural bases, e.g., ionosin and xanthine, non-natural sugars, e.g., 2'-methoxy ribose, or non-natural phosphodiester linkages, e.g., methylphosphonates, phosphorothioates and peptides.

Nucleic acid sequence: The phrase "nucleic acid sequence" refers to a single or double-stranded polymer of deoxyribonucleotide or ribonucleotide bases read from the 5'- to the 3'-end. It includes chromosomal DNA, self-replicating plasmids, infectious polymers of DNA or RNA and DNA or RNA that performs a primarily structural role. "Nucleic acid sequence" also refers to a consecutive list of abbreviations, letters, characters or words, which represent nucleotides. In one embodiment, a nucleic acid can be a "probe" which is a relatively short nucleic acid, usually less than 100 nucleotides in length. Often a nucleic acid probe is from about 50 nucleotides in length to about 10 nucleotides in length. A "target region" of a nucleic acid is a portion of a nucleic acid that is identified to be of interest. A "coding region" of a nucleic acid is the portion of the nucleic acid, which is transcribed and translated in a sequence-specific manner to produce into a particular polypeptide or protein when placed under the control of appropriate regulatory sequences. The coding region is said to encode such a polypeptide or protein.

Nucleotide sequence of interest: The term "nucleotide sequence of interest" refers to any nucleotide sequence, the manipulation of which may be deemed desirable for any reason (e.g., confer improved qualities), by one of ordinary skill in the art. Such nucleotide sequences include, but are not limited to, coding sequences of structural genes (e.g., reporter genes, selection marker genes, drug resistance genes, growth factors, etc.), and non-coding regulatory sequences which do not encode an mRNA or protein product, (e.g., promoter sequence, polyadenylation sequence, termination sequence, enhancer sequence, etc.). A nucleic acid sequence of interest may preferably encode for an agronomically valuable trait.

Oligonucleotide: The term "oligonucleotide" refers to an oligomer or polymer of ribonucleic acid (RNA) or deoxyribonucleic acid (DNA) or mimetics thereof, as well as oligonucleotides having non-naturally-occurring portions which function similarly. Such modified or substituted oligonucleotides are often preferred over native forms because of desirable properties such as, for example, enhanced cellular uptake, enhanced affinity for nucleic acid target and increased stability in the presence of nucleases. An oligonucleotide preferably includes two or more nucleomonomers covalently coupled to each other by linkages (e.g., phosphodiesters) or substitute linkages.

Operable linkage: The term "operable linkage" or "operably linked" is to be understood as meaning, for example, the sequential arrangement of a regulatory element (e.g. a promoter) with a nucleic acid sequence to be expressed and, if appropriate, further regulatory elements (such as e.g., a terminator) in such a way that each of the regulatory elements can fulfill its intended function to allow, modify, facilitate or otherwise influence expression of said nucleic acid sequence. The expression may result depending on the arrangement of the nucleic acid sequences in relation to sense or antisense RNA. To this end, direct linkage in the chemical sense is not necessarily required. Genetic control sequences such as, for example, enhancer sequences, can also exert their function on the target sequence from positions which are further away, or indeed from other DNA molecules. Preferred arrangements are those in which the nucleic acid sequence to be expressed recombinantly is positioned behind the sequence acting as promoter, so that the two sequences are linked covalently to each other. The distance between the promoter sequence and the nucleic acid sequence to be expressed recombinantly is preferably less than 200 base pairs, especially preferably less than 100 base pairs, very especially preferably less than 50 base pairs. In a preferred embodiment, the nucleic acid sequence to be transcribed is located behind the promoter in such a way that the transcription start is identical with the desired beginning of the chimeric RNA of the invention. Operable linkage, and an expression construct, can be generated by means of customary recombination and cloning techniques as described (e.g., in Maniatis T, Fritsch E F and Sambrook J (1989) Molecular Cloning: A Laboratory Manual, 2nd Ed., Cold Spring Harbor Laboratory, Cold Spring Harbor (NY); Silhavy et al. (1984) Experiments with Gene Fusions, Cold Spring Harbor Laboratory, Cold Spring Harbor (NY); Ausubel et al. (1987) Current Protocols in Molecular Biology, Greene Publishing Assoc. and Wiley Interscience; Gelvin et al. (Eds) (1990) Plant Molecular Biology Manual; Kluwer Academic Publisher, Dordrecht, The Netherlands). However, further sequences, which, for example, act as a linker with specific cleavage sites for restriction enzymes, or as a signal peptide, may also be positioned between the two sequences. The insertion of sequences may also lead to the expression of fusion proteins. Preferably, the expression construct, consisting of a linkage of promoter and nucleic acid sequence to be expressed, can exist in a vector-integrated form and be inserted into a plant genome, for example by transformation.

Organ: The term "organ" with respect to a plant (or "plant organ") means parts of a plant and may include (but shall not limited to) for example roots, fruits, shoots, stem, leaves, anthers, sepals, petals, pollen, seeds, etc. The term "organ" with respect to an animal ("animal organ") means parts of an animal and may include (but shall not limited to) for example external organs (such as arms, legs, head, etc.) or internal organs (such as heart, kidney, liver, stomach, etc.).

Overhang: An "overhang" is a relatively short single-stranded nucleotide sequence on the 5'- or 3'-hydroxyl end of a double-stranded oligonucleotide molecule (also referred to as an "extension," "protruding end," or "sticky end").

Plant: The terms "plant" or "plant organism" refer to any organism, which is capable of photosynthesis, and the cells, tissues, parts or propagation material (such as seeds or fruits) derived therefrom. Encompassed within the scope of the invention are all genera and species of higher and lower plants of the Plant Kingdom. Annual, perennial, monocotyledonous and dicotyledonous plants and gymnosperms are preferred. A "plant" refers to any plant or part of a plant at any stage of development. Mature plants refer to plants at any developmental stage beyond the seedling stage. Encompassed are mature plant, seed, shoots and seedlings, and parts, propagation material (for example tubers, seeds or fruits) and cultures, for example cell cultures or callus cultures) derived therefrom. Seedling refers to a young, immature plant at an early developmental stage. Therein are also included cuttings, cell or tissue cultures and seeds. As used in conjunction with the present invention, the term "plant tissue" includes, but is not limited to, whole plants, plant cells, plant organs, plant seeds, protoplasts, callus, cell cultures, and any groups of plant cells organized into structural and/or functional units. Preferably, the term "plant" as used herein refers to a plurality of plant cells, which are largely differentiated into a structure that is present at any stage of a plant's development. Such structures include one or more plant organs including, but are not limited to, fruit, shoot, stem, leaf, flower petal, etc. More preferably, the term "plant" includes whole plants, shoot vegetative organs/structures (e.g. leaves, stems and tubers), roots, flowers and floral organs/structures (e.g. bracts, sepals, petals, stamens, carpels, anthers and ovules), seeds (including embryo, endosperm, and seed coat) and fruits (the mature ovary), plant tissues (e.g. vascular tissue, ground tissue, and the like) and cells (e.g.—guard cells, egg cells, trichomes and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid and hemizygous. Included within the scope of the invention are all genera and species of higher and lower plants of the plant kingdom. Included are furthermore the mature plants, seed, shoots and seedlings, and parts, propagation material (for example seeds and fruit) and cultures, for example cell cultures, derived therefrom. Preferred are plants and plant materials of the following plant families: Amaranthaceae, Brassicaceae, Carophyllaceae, Chenopodiaceae, Compositae, Cucurbitaceae, Labiatae, Leguminosae, Papilionoideae, Liliaceae, Linaceae, Malvaceae, Rosaceae, Saxifragaceae, Scrophulariaceae, Solanaceae, Tetragoniaceae. Annual, perennial, monocotyledonous and dicotyledonous plants are preferred host organisms for the generation of transgenic plants. The use of the recombination system, or method according to the invention is furthermore advantageous in all ornamental plants, forestry, fruit, or ornamental trees, flowers, cut flowers, shrubs or turf. Said plant may include—but shall not be limited to—bryophytes such as, for example, Hepaticae (hepaticas) and Musci (mosses); pteridophytes such as ferns, horsetail and clubmosses; gymnosperms such as conifers, cycads, ginkgo and Gnetaeae; algae such as Chlorophyceae, Phaeophpyceae, Rhodophyceae, Myxophyceae, Xanthophyceae, Bacillariophyceae (diatoms) and Euglenophyceae. Plants for the purposes of the invention may comprise the families of the Rosaceae such as rose, Ericaceae such as rhododendrons and azaleas, Euphorbiaceae such as poinsettias and croton, Caryophyllaceae such as pinks, Solanaceae such as petunias, Gesneriaceae such as African violet, Balsaminaceae such as touch-me-not, Orchidaceae such as orchids, Iridaceae such as gladioli, iris, freesia and crocus, Compositae such as marigold, Geraniaceae such as geraniums, Liliaceae such as Drachaena, Moraceae such as *ficus*, Araceae such as philodendron and many others. The transgenic plants according to the invention are furthermore selected in particular from among dicotyledonous crop plants such as, for example, from the families of the Leguminosae such as pea, alfalfa and soybean; the family of the Umbelliferae, particularly the genus *Daucus* (very particularly the species *carota* (carrot)) and *Apium* (very particularly the species *graveolens* var. *dulce* (celery)) and many others; the family of the Solanaceae, particularly the genus *Lycopersicon*, very particularly the species *esculentum* (tomato) and the genus *Solanum*, very particularly the species *tuberosum* (potato) and *melongena* (aubergine), tobacco and many others; and the genus *Capsicum*, very particularly the species *annum* (pepper) and many others; the family of the Leguminosae, particularly the genus *Glycine*, very particularly the species *max* (soybean) and many others; and the family of the Cruciferae, particularly the genus *Brassica*, very particularly the species *napus* (oilseed rape), *campestris* (beet), *oleracea* cv Tastie (cabbage), *oleracea* cv Snowball Y (cauliflower) and *oleracea* cv Emperor (broccoli); and the genus *Arabidopsis*, very particularly the species *thaliana* and many others; the family of the Compositae, particularly the genus *Lactuca*, very particularly the species sativa (lettuce) and many others. The transgenic plants according to the invention are selected in particular among monocotyledonous crop plants, such as, for example, cereals such as wheat, barley, sorghum and millet, rye, triticale, maize, rice or oats, and sugarcane. Further preferred are trees such as apple, pear, quince, plum, cherry, peach, nectarine, apricot, papaya, mango, and other woody species including coniferous and deciduous trees such as poplar, pine, *sequoia*, cedar, oak, etc. Especially preferred are *Arabidopsis thaliana, Nicotiana tabacum*, oilseed rape, soybean, corn (maize), wheat, linseed, potato and tagetes.

Polynucleotide construct. The term "polynucleotide construct" refers to a nucleic acid at least partly created by recombinant methods. The term "DNA construct" is referring to a polynucleotide construct consisting of deoxyribonucleotides. The construct may be single- or—preferably—double stranded. The construct may be circular or linear. The skilled worker is familiar with a variety of ways to obtain one of a DNA construct. Constructs can be prepared by means of customary recombination and cloning techniques as are described, for example, in Maniatis T, Fritsch E F and Sambrook J (1989) Molecular Cloning: A Laboratory Manual, 2nd Ed., Cold Spring Harbor Laboratory, Cold Spring Harbor (NY); Silhavy et al. (1984) Experiments with Gene Fusions, Cold Spring Harbor Laboratory, Cold Spring Harbor (NY); Ausubel et al. (1987) Current Protocols in Molecular Biology, Greene Publishing Assoc. and Wiley Interscience; Gelvin et al. (Eds) (1990) Plant Molecular Biology Manual; Kluwer Academic Pub-lisher, Dordrecht, The Netherlands.

Polypeptide: The terms "polypeptide", "peptide", "oligopeptide", "polypeptide", "gene product", "expression product" and "protein" are used interchangeably herein to refer to a polymer or oligomer of consecutive amino acid residues.

Pre-protein: Protein, which is normally targeted to a cellular organelle, such as a chloroplast, and still comprising its transit peptide.

Promoter: The terms "promoter," "promoter element," or "promoter sequence" are equivalents and as used herein, refers to a DNA sequence which when ligated to a nucleotide sequence of interest is capable of controlling the transcription of the nucleotide sequence of interest into mRNA. A promoter is typically, though not necessarily, located 5' (i.e., upstream) of a nucleotide sequence of interest (e.g., proximal to the transcriptional start site of a structural gene) whose transcription into mRNA it controls, and provides a site for specific binding by RNA polymerase and other transcription factors for initiation of transcription. A polynucleotide sequence is "heterologous to" an organism or a second polynucleotide sequence if it originates from a foreign species, or, if from the same species, is modified from its original form. For example, a promoter operably linked to a heterologous coding sequence refers to a coding sequence from a species different from that from which the promoter was derived, or, if from the same species, a coding sequence which is not naturally associated with the promoter (e.g. a genetically engineered coding sequence or an allele from a different ecotype or variety). Suitable promoters can be derived from genes of the host cells where expression should occur or from pathogens for this host cells (e.g., plants or plant pathogens like plant viruses). If a promoter is an inducible promoter, then the rate of transcription increases in response to an inducing agent. In contrast, the rate of transcription is not regulated by an inducing agent if the promoter is a constitutive promoter. Also, the promoter may be regulated in a tissue-specific or tissue preferred manner such that it is only active in transcribing the associated coding region in a specific tissue type(s) such as leaves, roots or meristem. The term "tissue specific" as it applies to a promoter refers to a promoter that is capable of directing selective expression of a nucleotide sequence of interest to a specific type of tissue (e.g., petals) in the relative absence of expression of the same nucleotide sequence of interest in a different type of tissue (e.g., roots). Tissue specificity of a promoter may be evaluated by, for example, operably linking a reporter gene to the promoter sequence to generate a reporter construct, introducing the reporter construct into the genome of a plant such that the reporter construct is integrated into every tissue of the resulting transgenic plant, and detecting the expression of the reporter gene (e.g., detecting mRNA, protein, or the activity of a protein encoded by the reporter gene) in different tissues of the transgenic plant. The detection of a greater level of expression of the reporter gene in one or more tissues relative to the level of expression of the reporter gene in other tissues shows that the promoter is specific for the tissues in which greater levels of expression are detected. The term "cell type specific" as applied to a promoter refers to a promoter, which is capable of directing selective expression of a nucleotide sequence of interest in a specific type of cell in the relative absence of expression of the same nucleotide sequence of interest in a different type of cell within the same tissue. The term "cell type specific" when applied to a promoter also means a promoter capable of promoting selective expression of a nucleotide sequence of interest in a region within a single tissue. Cell type specificity of a promoter may be assessed using methods well known in the art, e.g., GUS activity staining or immunohistochemical staining. The term "constitutive" when made in reference to a promoter means that the promoter is capable of directing transcription of an operably linked nucleic acid sequence in the absence of a stimulus (e.g., heat shock, chemicals, light, etc.). Typically, constitutive promoters are capable of directing expression of a transgene in substantially any cell and any tissue. In contrast, a "regulatable" promoter is one which is capable of directing a level of transcription of an operably linked nuclei acid sequence in the presence of a stimulus (e.g., heat shock, chemicals, light, etc.) which is different from the level of transcription of the operably linked nucleic acid sequence in the absence of the stimulus.

Purified: As used herein, the term "purified" refers to molecules, either nucleic or amino acid sequences that are removed from their natural environment, isolated or separated.

"Substantially purified" molecules are at least 60% free, preferably at least 75% free, and more preferably at least 90% free from other components with which they are naturally associated. A purified nucleic acid sequence may be an isolated nucleic acid sequence.

Recombinant: The term "recombinant" with respect to polypeptides or proteins refer to polypeptides or proteins produced by recombinant DNA techniques, i.e., produced from cells transformed by an exogenous recombinant DNA construct encoding the desired polypeptide or protein. Recombinant nucleic acids and polypeptide may also comprise molecules, which as such does not exist in nature but are modified, changed, mutated or otherwise manipulated by man. Preferably, a "recombinant polypeptide" is a non-naturally occurring polypeptide that differs in sequence from a naturally occurring polypeptide by at least one amino acid residue. Preferred methods for producing said recombinant polypeptide and/or nucleic acid may comprise directed or non-directed mutagenesis, DNA shuffling or other methods of recursive recombination.

Sense: The term "sense" is understood to mean a nucleic acid having a sequence which is homologous or identical to a target sequence, for example a sequence which binds to a protein transcription factor and which is involved in the expression of a given gene. According to a preferred embodiment, the nucleic acid comprises a gene of interest and elements allowing the expression of the said gene of interest.

Significant Increase or Decrease: An increase or decrease, for example in enzymatic activity or in gene expression, that is larger than the margin of error inherent in the measurement technique, preferably an increase or decrease by about 2-fold or greater of the activity of the control enzyme or expression in the control cell, more preferably an increase or decrease by about 5-fold or greater, and most preferably an increase or decrease by about 10-fold or greater.

Stabilize: To "stabilize" the expression of a nucleotide sequence in a plant cell means that the level of expression of the nucleotide sequence after applying a method of the present invention is approximately the same in cells from the same tissue in different plants from the same generation or throughout multiple generations when the plants are grown under the same or comparable conditions.

Substantially complementary: In its broadest sense, the term "substantially complementary", when used herein with respect to a nucleotide sequence in relation to a reference or target nucleotide sequence, means a nucleotide sequence having a percentage of identity between the substantially complementary nucleotide sequence and the exact complementary sequence of said reference or target nucleotide sequence of at least 60%, more desirably at least 70%, more desirably at least 80% or 85%, preferably at least 90%, more preferably at least 93%, still more preferably at least 95% or 96%, yet still more preferably at least 97% or 98%, yet still more preferably at least 99% or most preferably 100% (the later being equivalent to the term "identical" in this context). Preferably identity is assessed over a length of at least 19 nucleotides, preferably at least 50 nucleotides, more preferably the entire length of the nucleic acid sequence to said reference sequence (if not specified otherwise below). Sequence comparisons are carried out using default GAP analysis with the University of Wisconsin GCG, SEQWEB application of GAP, based on the algorithm of Needleman and Wunsch (Needleman and Wunsch (1970) J. Mol. Biol. 48: 443-453; as defined above). A nucleotide sequence "substantially complementary" to a reference nucleotide sequence hybridizes to the reference nucleotide sequence under low stringency conditions, preferably medium stringency conditions, most preferably high stringency conditions (as defined above).

Substantially identical: In its broadest sense, the term "substantially identical", when used herein with respect to a nucleotide sequence, means a nucleotide sequence corresponding to a reference or target nucleotide sequence, wherein the percentage of identity between the substantially identical nucleotide sequence and the reference or target nucleotide sequence is desirably at least 60%, more desirably at least 70%, more desirably at least 80% or 85%, preferably at least 90%, more preferably at least 93%, still more preferably at least 95% or 96%, yet still more preferably at least 97% or 98%, yet still more preferably at least 99% or most preferably 100% (the later being equivalent to the term "identical" in this context). Preferably identity is assessed over a length of at least 19 nucleotides, preferably at least 50 nucleotides, more preferably the entire length of the nucleic acid sequence to said reference sequence (if not specified otherwise below). Sequence comparisons are carried out using default GAP analysis with the University of Wisconsin GCG, SEQWEB application of GAP, based on the algorithm of Needleman and Wunsch (Needleman and Wunsch (1970) J. Mol. Biol. 48: 443-453; as defined above). A nucleotide sequence "substantially identical" to a reference nucleotide sequence hybridizes to the exact complementary sequence of the reference nucleotide sequence (i.e. its corresponding strand in a double-stranded molecule) under low stringency conditions, preferably medium stringency conditions, most preferably high stringency conditions (as defined above). Homologes of a specific nucleotide sequence include nucleotide sequences that encode an amino acid sequence that is at least 24% identical, more preferably at least 35% identical, yet more preferably at least 50% identical, yet more preferably at least 65% identical to the reference amino acid sequence, as measured using the parameters described above, wherein the amino acid sequence encoded by the homolog has the same biological activity as the protein encoded by the specific nucleotide. The term "substantially identical", when used herein with respect to a polypeptide, means a protein corresponding to a reference polypeptide, wherein the polypeptide has substantially the same structure and function as the reference protein, e.g. where only changes in amino acids sequence not affecting the polypeptide function occur. When used for a polypeptide or an amino acid sequence the percentage of identity between the substantially similar and the reference polypeptide or amino acid sequence desirably is at least 24%, more desirably at least 30%, more desirably at least 45%, preferably at least 60%, more preferably at least 75%, still more preferably at least 90%, yet still more preferably at least 95%, yet still more preferably at least 99%, using default GAP analysis parameters as described above. Homologes are amino acid sequences that are at least 24% identical, more preferably at least 35% identical, yet more preferably at least 50% identical, yet more preferably at least 65% identical to the reference polypeptide or amino acid sequence, as measured using the parameters described above, wherein the amino acid sequence encoded by the homolog has the same biological activity as the reference polypeptide.

Synthetic: As used herein, "synthetic" means made wholly by chemical means, e.g. through the annealing of chemically-synthesized complementary oligonucleotides rather than by biological means, e.g. through the amplification of a chemically-synthesized template using the polymerase chain reaction (PCR) or other enzyme-mediated biological reactions such as ligation or phosphorylation. In preferred embodiments, the oligonucleotides are synthesized using commercial oligonucleotide synthesis machines, including but not limited to the ABI 394 and ABI 3900 DNA/RNA Synthesizers available from Applied Biosystems, Inc. or other commercially-equivalent synthesizers.

Target gene: The terms "target", "target gene" and "target nucleotide sequence" are used equivalently. As used herein, a target gene can be any gene of interest present in a eukaryotic organism (such as a plant). A target gene may be endogenous or introduced. For example, a target gene is a gene of known function or is a gene whose function is unknown, but whose total or partial nucleotide sequence is known. Alternatively, the function of a target gene and its nucleotide sequence are both unknown. A target gene is a native gene of the eukaryotic cell or is a heterologous gene which has previously been introduced into the eukaryotic cell or a parent cell of said eukaryotic cell, for example by genetic transformation. A heterologous target gene is stably integrated in the genome of the eukaryotic cell or is present in the eukaryotic cell as an extrachromosomal molecule, e.g. as an autonomously replicating extrachromosomal molecule. A target gene may include polynucleotides comprising a region that encodes a polypeptide or polynucleotide region that regulates replication, transcription, translation, or other process important in expression of the target protein; or a polynucleotide comprising a region that encodes the target polypeptide and a region that regulates expression of the target polypeptide; or non-coding regions such as the 5' or 3' UTR or introns. A target gene may refer to, for example, an mRNA molecule produced by transcription a gene of interest. Furthermore, the term "correspond," as in "a chimeric RNA comprising a sequence that corresponds to a target gene sequence," means that the two sequences are complementary or homologous or bear such other biologically rational relationship to each other (e.g., based on the sequence of nucleomonomers and their base-pairing properties). The "target gene" to which a chimeric RNA molecule of the invention is directed may be associated with a pathological condition. For example, the gene may be a pathogen-associated gene, e.g., a viral gene, a tumor-associated gene, a defective gene (e.g., an abnormal cancer-causing gene), or an autoimmune disease-associated gene. The target gene may also be a heterologous gene expressed in a recombinant cell or a genetically altered organism. By determining or modulating (e.g., inhibiting) the function of such a gene, valuable information and therapeutic benefits in medicine, veterinary medicine, and biology may be obtained.

Tissue: The term "tissue" with respect to an organism (e.g., a plant; "plant tissue") means arrangement of multiple cells including differentiated and undifferentiated tissues of the organism. Tissues may constitute part of an organ (e.g., the epidermis of a plant leaf or an animal skin) but may also constitute tumor tissues (e.g., callus tissue) and various types of cells in culture (e.g., single cells, protoplasts, embryos, calli, protocorm-like bodies, etc.). The tissue may be in vivo (e.g., in planta), in organ culture, tissue culture, or cell culture.

Transformation: The term "transformation" as used herein refers to the introduction of genetic material (e.g., a transgene or heterologous nucleic acid molecules) into a cell, tissue or organism. Transformation of a cell may be stable or transient. The term "transient transformation" or "transiently transformed" refers to the introduction of one or more transgenes into a cell in the absence of integration of the transgene into the host cell's genome. Transient transformation may be detected by, for example, enzyme-linked immunosorbent assay (ELISA), which detects the presence of a polypeptide encoded by one or more of the transgenes. Alternatively, transient transformation may be detected by detecting the activity of the protein (e.g., 洄-glucuronidase) encoded by the transgene (e.g., the uid A gene). The term "transient transformant" refers to a cell which has transiently incorporated one or more transgenes. In contrast, the term "stable transformation" or "stably transformed" refers to the introduction and integration of one or more transgenes into the genome of a cell, preferably resulting in chromosomal integration and stable heritability through meiosis. Stable transformation of a cell may be detected by Southern blot hybridization of genomic DNA of the cell with nucleic acid sequences, which are capable of binding to one or more of the transgenes. Alternatively, stable transformation of a cell may also be detected by the polymerase chain reaction of genomic DNA of the cell to amplify transgene sequences. The term "stable transformant" refers to a cell, which has stably integrated one or more transgenes into the genomic DNA. Thus, a stable transformant is distinguished from a transient transformant in that, whereas genomic DNA from the stable transformant contains one or more transgenes, genomic DNA from the transient transformant does not contain a transgene. Transformation also includes introduction of genetic material into plant cells in the form of plant viral vectors involving epichromosomal replication and gene expression, which may exhibit variable properties with respect to meiotic stability. Transformed cells, tissues, or plants are understood to encompass not only the end product of a transformation process, but also transgenic progeny thereof.

Transgene: The term "transgene" as used herein refers to any nucleic acid sequence, which is introduced into the genome of a cell by experimental manipulations. A transgene may be an "endogenous DNA sequence," or a "heterologous DNA sequence" (i.e., "foreign DNA"). The term "endogenous DNA sequence" refers to a nucleotide sequence, which is naturally found in the cell into which it is introduced so long as it does not contain some modification (e.g., a point mutation, the presence of a selectable marker gene, etc.) relative to the naturally-occurring sequence.

Transgenic: The term transgenic when referring to a cell, tissue or organisms means transformed, preferably stably transformed, with a recombinant DNA molecule that preferably comprises a suitable promoter operatively linked to a DNA sequence of interest.

Unaffected: As used herein, "essentially unaffected" refers to a level of an agent such as a protein or mRNA transcript that is either not altered by a particular event or altered only to an extent that does not affect the physiological function of that agent. In a preferred aspect, the level of the agent that is essentially unaffected is within 20%, more preferably within 10%, and even more preferably within 5% of the level at which it is found in a cell or organism that lacks a nucleic acid molecule capable of selectively reducing another agent. As used herein, "substantially unaffected" refers to a level of an agent such as a protein or mRNA transcript in which the level of the agent that is substantially unaffected is within 49%, more preferably within 35%, and even more preferably within 24% of the level at which it is found in a cell or organism that lacks a nucleic acid molecule capable of selectively reducing another agent. As used herein, "partially unaffected" refers to a level of an agent such as a protein or mRNA transcript in which the level of the agent that is partially unaffected is within 80%, more preferably within 65%, and even more preferably within 50% of the level at which it is found in a cell or organism that lacks a nucleic acid molecule capable of selectively reducing another agent.

Vector: As used herein, the term "vector" refers to a nucleic acid molecule capable of transporting another nucleic acid to which it has been linked. One type of vector is a genomic integrated vector, or "integrated vector", which can become integrated into the chromosomal DNA of the host cell. Another type of vector is an episomal vector, i.e., a nucleic acid capable of extra-chromosomal replication. Vectors capable of directing the expression of genes to which they are operatively linked are referred to herein as "expression vectors". In the present specification, "plasmid" and "vector" are used interchangeably unless otherwise clear from the context. Expression vectors designed to produce RNAs as described herein in vitro or in vivo may contain sequences under the control of any RNA polymerase, including mitochondrial RNA polymerase, RNA pol I, RNA pol II, and RNA pol III. These vectors can be used to transcribe the desired RNA molecule in the cell according to this invention. Vectors may be desirably designed to utilize an endogenous mitochondrial RNA polymerase (e.g., human mitochondrial RNA polymerase, in which case such vectors may utilize the corresponding human mitochondrial promoter). Mitochondrial polymerases may be used to generate capped (through expression of a capping enzyme) or uncapped messages in vivo. RNA pol I, RNA pol II, and RNA pol III transcripts may also be generated in vivo. Such RNAs may be capped or not, and if desired, cytoplasmic capping may be accomplished by various means including use of a capping enzyme such as a vaccinia capping enzyme or an alphavirus capping enzyme. The DNA vector is designed to contain one of the promoters or multiple promoters in combination (mitochondrial, RNA polI, II, or polIII, or viral, bacterial or bacteriophage promoters along with the cognate polymerases). Preferably, where the promoter is RNA pol II, the sequence encoding the RNA molecule has an open reading frame greater than about 300 nts to avoid degradation in the nucleus. Such plasmids or vectors can include plasmid sequences from bacteria, viruses or phages. Such vectors include chromosomal, episomal and virus-derived vectors e.g., vectors derived from bacterial plasmids, bacteriophages, yeast episomes, yeast chromosomal elements, and viruses, vectors derived from combinations thereof, such as those derived from plasmid and bacteriophage genetic elements, cosmids and phagemids. Thus, one exemplary vector is a single or double-stranded phage vector. Another exemplary vector is a single or double-stranded RNA or DNA viral vector. Such vectors may be introduced into cells as polynucleotides, preferably DNA, by well known techniques for introducing DNA and RNA into cells. The vectors, in the case of phage and viral vectors may also be and preferably are introduced into cells as packaged or encapsidated virus by well known techniques for infection and transduction. Viral vectors may be replication competent or replication defective. In the latter case, viral propagation generally occurs only in complementing host cells.

Wild-type: The term "wild-type", "natural" or of "natural origin" means with respect to an organism, polypeptide, or nucleic acid sequence, that said organism is naturally occurring or available in at least one naturally occurring organism which is not changed, mutated, or otherwise manipulated by man.

DETAILED DESCRIPTION OF THE INVENTION

A first embodiment of the invention relates to a method for silencing or attenuating expression of at least one target gene said method comprising introducing or expressing into said plant or a part thereof a chimeric ribonucleotide sequence comprising a modified ta-siRNA sequence, wherein in said sequence is modified in relation to a natural ta-siRNA sequence by at least replacing one phase region of said natural ta-siRNA by a sequence, which is substantially complementary to said target gene and which is heterologous with regard to said natural ta-siRNA.

The essential, inventive feature of the invention disclosed herein is to employ the natural gene silencing capacity of ta-siRNA to silence or attenuate virtually any gene if interest in plants, but replacing one of the natural phases of said ta-siRNA by a sequence corresponding to the target gene of interest.

It is of special interest and inventive advantage that virtually all ta-siRNAs have more than one phase. This allows for simultaneously silencing more than one (e.g. 2, 3, 4, 5, 6, 7, 8) different target genes by replacing the natural phases with sequences corresponding to said different target gene of interest. Thereby coordinated silencing of multiple genes can be achieved, which is so far a very complicated task and an unfilled need in the area of biotechnology. This goal can be readily achieved by the methods and subject matters of the present invention.

Without being limited to any specific functional mechanism of action, the endogenous miRNA is thought to interact with the miRNA-tag in the chimeric RNA sequence, thereby inducing its degradation (or gene silencing). This silencing is surprisingly found to be restricted to the tissue, time, and/or under environmental condition where the endogenous miRNA is naturally expressed and is found not to spread over the entire organism.

1. The Chimeric ta-siRNA

The term "chimeric RNA" or "chimeric RNA molecule" or "chimeric ribonucleotide sequence" are used interchangeable herein and are intended to mean a polynucleotide molecule, which is at least in part consisting of ribonucleotides, which comprises at least in part of a natural ta-siRNA molecule covalently linked to another sequence which is heterogeneous to said ta-siRNA sequence (i.e. not linked to it in its natural form).

The fact the chimeric RNA sequence of the invention is "at least in part consisting of ribonucleotides" means—for example—that the chimeric RNA sequence may comprise other than ribonucleotide bases. As described below, the chimeric RNA molecule of the invention may also be obtained by chemically synthesis. By this method, other than natural occurring ribonucleotide residues (e.g., modified residues) may be incorporated).

Specifically the term "chimeric ribonucleotide sequence" means a polynucleotide molecule, which is at least in part (preferably completely) consisting of ribonucleotides, comprising a modified ta-siRNA sequence, wherein in said sequence is modified in relation to a natural ta-siRNA sequence by at least replacing one phase region of said natural ta-siRNA by a sequence, which is substantially complementary to said target gene and which is heterologous with regard to said natural ta-siRNA. Modified means that also parts of a natural ta-siRNA moelcule might be sufficient to achieve the inventive results. Preferably the chimeric ribonucleotide molecule comprises at least 50%, preferably at least 60% or 70%, more preferably at least 80% or 90%, most preferably at least 95% of the sequence information of a natural ta-siRNA molecule.

1.1 Identification and Isolation of the Natural ta-siRNA to be Engineered

The person skilled in the art is aware of various ta-siRNAs, which may be utilized for the present invention. The term "Ta-siRNA" or "trans-acting siRNA" as used herein means a ribonucleotide sequence with transcating silencing properties. Ta-siRNAs are one subclass of the class of siRNAs (small-interefering RNAs), which class comprises at least said endogenous trans-acting siRNA (ta-siRNA), repeat-associated siRNA (rasiRNA), and small scan RNA (scnRNA). Ta-siRNAs are endogenous trans-acting siRNAs, which direct cleavage of endogenous cognate mRNAs in trans (the target genes are different from the gene that the siRNA originates). Ta-siRNAs may be generated from an intron of a non-coding gene (e.g., in *Arabidopsis* Vazquez et al., 2004b). Biogenesis of these RNAs seems to be dependent on genes that belong to two distinct pathways: AG01, DCL1, HEN1, HYL1 (required for miRNA pathways) and RDR6 and SGS3 (required for virus-induced cis-acting siRNA pathways). Target genes of the natural ta-siRNAs can be predicted based on their extensive complementarity. So far ta-siRNAs have been found only in plants and nematode worms, which possess RNA-dependent RNA polymerases (RdRPs). Ta-siRNAs may be confined in organisms with RdRPdependent dsRNA production system but not in organisms such as mammals that lack this system (for details see Kim V N (2005) Mol. Cells. 19(1):1-15). Ta-siRNAs direct hetero-silencing, repressing the expression of genes that bear little resemblance to the genes from which they derived. In this sense, other endogenous siRNAs that have been characterized are cis-acting, performing auto-silencing to repress the expression of genes that are the same or very similar to the loci from which they derive (Vazquez et al., (2004) Mol Cell 69-79). Biogenesis of trans-acting siRNAs (ta-siRNAs) requires DCL1 and RDR6 (Peragine A. et al. (2004) Genes Dev. 18:2368-237; Vazquez F et al. (2004) Mol. Cell. 16:69-79) In contrast to miRNA genes, ta-siRNA precursor transcripts do not form a foldback structure, but rather both sense and antisense small RNAs are processed from perfectly complementary RNA duplexes.

Thus the natural ta-siRNA sequence used (either materially or as sequence information) as starting material for constructing a chimeric ribonucleotide sequence of the invention is preferably described by a sequence selected from the group consisting of a) the sequences described by SEQ ID NO: 1, 2, 3, 4, 5, 6, 7, 8, 9, 10, 11, 12, 13, 14, 15, 16, 17, 18, and/or 20, and
b) sequences having an identity of at least 60% (preferably at least 70% or 80%, more preferably at least 85% or 90%, more preferably at least 95% or 98%, most preferably 99%) to a sequence selected from the group consisting of the sequences described by SEQ ID NO: 1, 2, 3, 4, 5, 6, 7, 8, 9, 10, 11, 12, 13, 14, 15, 16, 17, 18, and/or 20, and
c) sequences hybridizing under conditions equivalent to binding or hybridization at 68° C. in a solution consisting of 5×SSPE, 1% SDS, 5×Denhardt's reagent and 100 μg/mL denatured salmon sperm DNA followed by washing in a solution comprising 1×SSC and 0.1% SDS at room temperature when a DNA probe of at least 100 nucleotides (preferably 100 to about 1,000 nucleotides; more preferably at least 200 nucleotide, even more preferably at least 500 nucleotides) in length is employed to a sequences selected from the group consisting of the sequences described by SEQ ID NO: 1, 2, 3, 4, 5, 6, 7, 8, 9, 10, 11, 12, 13, 14, 15, 16, 17, 18, and/or 20 or a (absolute) complement thereof.

More preferred for the sequences under c) are those sequences hybridizing under conditions equivalent to binding or hybridization at 68° C. in a solution consisting of 5×SSPE, 1% SDS, 5×Denhardt's reagent and 100 μg/mL denatured salmon sperm DNA followed by washing in a solution comprising 0.1×SSC and 1% SDS at room temperature when a DNA probe of at least 100 nucleotides (preferably 100 to about 1,000 nucleotides; more preferably at least 200 nucleotide, even more preferably at least 500 nucleotides) in length is employed. More preferences for these conditions are given above in the DEFINITION section. Even more preferred for the sequences under c) are those sequences hybridizing under conditions equivalent to binding or hybridization at 68° C. in a solution consisting of 5×SSPE, 1% SDS, 5×Denhardt's reagent and 100 μg/mL denatured salmon sperm DNA followed by washing in a solution comprising 0.1×SSC, and 1% SDS at 68° C., when a probe of at least 100 nucleotides (preferably 100 to about 1,000 nucleotides; more preferably at least 200 nucleotide, even more preferably at least 500 nucleotides) in length is employed. More preferences for these conditions are given above in the DEFINITION section.

In general a ta-siRNAs can be identified by computer algorithm based on scoring criteria. Preferably, said scoring criteria may include the following eight criteria used:

1. 30%-52% GC content—Add 1 point for satisfying this criterion.
2. Three or more A/Us at positions 15-19 (sense)—Add 1 point for each A/U for a total up to 5 points. At least 3 points are required to be scored as positive ("+") in the final output.
3. The absence of internal repeats or hairpins as measured by a $T_m$<20 degrees C.—Add 1 point for satisfying this criterion.

4. A at position 19 (sense)—Add 1 point for satisfying this criterion.
5. A at position 3 (sense)—Add 1 point for satisfying this criterion.
6. U at position 10 (sense)—Add 1 point for satisfying this criterion.
7. No G/C at position 19 (sense)—Subtract 1 point for not satisfying this criterion.
8. No G at position 13 (sense)—Subtract 1 point for not satisfying this criterion A more elaborated protocol for identification of ta-siRNAs is described in Example 1 below. However other methods known in the art can be employed to identify additional ta-siRNAs. For example orthologous ta-siRNAs (e.g., ta-siRNAs corresponding to the ta-siRNAs specifically disclosed herein but derived from a different plant species) can also be derived by screening of (electronic or material) libraries. This can be done by either hybridization screening or screening via computer algorithms (e.g., blastn). Thus ta-siRNAs can be employed which have substantial identity on sequence base and/or hybridize (as defined above) to the ta-siRNAs specifically disclosed herein.

Beside the modification described above (replacement of a phase region and—optionally—replacement of the microRNA binding site) other modifications (e.g., mutations, deletions, additions, etc.) can be made. Accordingly said modified ta-siRNA can be described by a sequences comprising at least one sequence selected from the group consisting of a) the sequences described by SEQ ID NO: 1, 2, 3, 4, 5, 6, 7, 8, 9, 10, 11, 12, 13, 14, 15, 16, 17, 18, and/or 20, and
b) a fragment consisting of at least 50 consecutive nucleotides of a sequences described by SEQ ID NO: 1, 2, 3, 4, 5, 6, 7, 8, 9, 10, 11, 12, 13, 14, 15, 16, 17, 18, and/or 20
c) sequences having an identity of at least 60% (preferably at least 70% or 80%, more preferably at least 85% or 90%, more preferably at least 95% or 98%, most preferably 99%) to a sequence selected from the group consisting of the sequences described by SEQ ID NO: 1, 2, 3, 4, 5, 6, 7, 8, 9, 10, 11, 12, 13, 14, 15, 16, 17, 18, and 20, ands.
d) sequences hybridizing under conditions equivalent to binding or hybridization at 68° C. in a solution consisting of 5×SSPE, 1% SDS, 5×Denhardt's reagent and 100 μg/mL denatured salmon sperm DNA followed by washing in a solution comprising-1×SSC and 0.1% SDS at room temperature when a DNA probe of at least 100 nucleotides (preferably 100 to about 1000 nucleotides; more preferably at least 200 nucleotide, even more preferably at least 500 nucleotides) in length is employed to a sequences selected from the group consisting of the sequences described by SEQ ID NO: 1, 2, 3, 4, 5, 6, 7, 8, 9, 10, 11, 12, 13, 14, 15, 16, 17, 18, and/or 20 or a complement thereof.

More preferred for the sequences under c) are those sequences hybridizing under conditions equivalent to binding or hybridization at 68° C. in a solution consisting of 5×SSPE, 1% SDS, 5×Denhardt's reagent and 100 μg/mL denatured salmon sperm DNA followed by washing in a solution comprising 0.1×SSC and 1% SDS at room temperature when a DNA probe of at least 100 nucleotides (preferably 100 to about 1000 nucleotides; more preferably at least 200 nucleotide, even more preferably at least 500 nucleotides) in length is employed. More preferences for these conditions are given above in the DEFINITION section. Even more preferred for the sequences under c) are those sequences hybridizing under conditions equivalent to binding or hybridization at 68° C. in a solution consisting of 5×SSPE, 1% SDS, 5×Denhardt's reagent and 100 μg/mL denatured salmon sperm DNA followed by washing in a solution comprising 0.1×SSC, and 1% SDS at 68° C., when a probe of at least 100 nucleotides (preferably 100 to about 1,000 nucleotides; more preferably at least 200 nucleotide, even more preferably at least 500 nucleotides) in length is employed. More preferences for these conditions are given above in the DEFINITION section.

1.2 Replacement of the Phase Region of a ta-siRNA

The person skilled in the art is aware of methods to identify the phase regions in a ta-siRNA molecule. The term "phase region" means a region of about 21 nucleotides, which is processed by Dicer from a ta-siRNA primary transcript, and which preferably resembles substantial complementarity to at least one plant endogenous gene. These phases can be identified in general as follows (in exemplification for a miR173 ta-siRNA): For ta-siRNA formation by 5' initiation such as miR173-guided ta-siRNA, miR173 binds to its complementary site in the primary transcript and mediates the cleavage of the transcript between position 10 and 11 from 5' end of miR173. From this cleavage site, a series of about 21 nt phases of ta-siRNA are generated via 5' to 3' direction involving a group of key enzymes such as RDR6, SGS3 and Dicer. For ta-siRNA formation by 3' initiation such as miR390-guided ta-siRNA, a similar process applies except that the formation of ta-siRNA is via 3' to 5' direction starting from miR390 cleavage site.

A more detailed scheme how to identify the phases is described in Examples 2 and 3 below. For the ta-siRNA sequences specifically disclosed herein said phases are annotated in the sequences listing.

For the specific ta-siRNA molecules disclosed herein the phase region of said ta-siRNA to be replaced is selected from the group consisting of a) (for the maize ta-siRNA described by SEQ ID NO: 1) a phase region from the group described by nucleotides 688 to 708, 667 to 687, 646 to 666, 625 to 645, 604 to 624, 583 to 603, 562 to 582 and/or 541 to 561 of SEQ ID NO: 1, and
b) (for the wheat ta-siRNA described by SEQ ID NO: 2) a phase region from the group described by nucleotides 585 to 605, 564 to 584, 543 to 563, 522 to 542 and/or 501 to 521 of SEQ ID NO: 2, and
c) (for the rice ta-siRNA described by SEQ ID NO: 3) a phase region from the group described by nucleotides 525 to 546, 504 to 524, 483 to 503, 462 to 482, 441 to 461, 420 to 440 and/or 399 to 419 of SEQ ID NO: 3, and
d) (for the cotton ta-siRNA TC31385 described by SEQ ID NO: 4) a phase region from the group described by nucleotides 591 to 612, 570 to 590, 549 to 569, 528 to 548, 507 to 527, 486 to 506, 465 to 485, and/or 444 to 464 of SEQ ID NO: 4, and
e) (for the soybean ta-siRNA TC228167 described by SEQ ID NO: 5) a phase region from the group described by nucleotides 595 to 616, 574 to 594, 553 to 573, 532 to 552, 511 to 531, 490 to 510, 469 to 489, and/or 448 to 468 of SEQ ID NO: 5, and
f) (for the Canola ta-siRNA 51296077 described by SEQ ID NO: 6) a phase region from the group described by nucleotides 396 to 416, 375 to 395, 354 to 374, 333 to 353, 312 to 332, 291 to 311, 270 to 290, and/or 249 to 269 of SEQ ID NO: 6, and
g) (for the sunflower ta-siRNA described by SEQ ID NO 7) a phase region from the group described by nucleotides 469 to 489, 448 to 468, 427 to 467, 406 to 426, 385 to 405, 364 to 384, 343 to 363, and/or 322 to 342 of SEQ ID NO: 7, and h) (for barley ta-siRNA described by SEQ ID NO: 8) a phase region from the group described by nucleotides 482-503, 461-481, 440-460, 419-439 and/or 398-418 SEQ ID NO: 8, and i) (for the tomato ta-siRNA described by SEQ ID NO: 9) a phase region from the group described by nucleotides 504 to 525, 483 to 503, 462 to 482, 441 to 461, 420 to 440, 399 to 419, 378 to 398, and/or 357 to 377 of SEQ ID NO: 9, and j) (for the sorghum ta-siRNA described by SEQ ID NO 10) a phase region from the group described by nucleotides 510-531, 489-509, 468-488, 447-467, 426-446 and/or 405-425 of SEQ ID NO: 10, and k) (for the spruce ta-siRNA described by SEQ ID NO: 11) a phase region from the group described by nucleotides 301 to 322, 280 to 300, 259 to 279, 238 to 258, 217 to 237, 196 to 216, 175 to 195, and/or 154 to 174 of SEQ ID NO: 11, and l) (for the cocoa ta-siRNA described by SEQ ID NO: 12) a phase region from the group described by nucleotides 373 to 393, 352 to 372, 331 to 351, 310 to 330, 289 to 309, 268 to 288, 247 to 267, and/or 226 to 246 of SEQ ID NO: 12, and m) (for the grape ta-siRNA described by SEQ ID NO: 13) a phase region from the group described by nucleotides 445 to 465, 424 to 444, 403 to 423, 382 to 402, 361 to 381, 340 to 360, 319 to 339, and/or 298 to 318 of SEQ ID NO: 13, and n) (for the lotus ta-siRNA described by SEQ ID NO: 14) a phase region from the group described by nucleotides 203 to 224, 182 to 202, 161 to 181, 140 to 160, 119 to 139, 98 to 118, 77 to 97, and/or 56 to 76 of SEQ ID NO: 14, and o) (for the *populus* ta-siRNA described by SEQ ID NO: 15) a phase region from the group described by nucleotides 1084 to 1105, 1063 to 1083, 1042 to 1062, 1021 to 1041, 1000 to 1020, 9799 to 999, 958 to 978, and/or 937 to 957 of SEQ ID NO: 15, and p) (for the *Arabidopsis thaliana* ta-siRNA TAS1a described by SEQ ID NO: 16) a phase region from the group described by nucleotides 436 to 456, 457 to 477, 478 to 498, 499 to 519, 520 to 540, 541 to 561, 562 to 582 and/or 583 to 603 of SEQ ID NO: 16, and q) (for the *Arabidopsis thaliana* ta-siRNA Arab TAS1b described by SEQ ID NO: 17) a phase region from the group described by nucleotides 592 to 612, 613 to 633, 634 to 654, 655 to 675, 676 to 696 and/or 697 to 717 of SEQ ID NO: 17, and r) (for the *Arabidopsis thaliana* ta-siRNA Arab TAS1c described by SEQ ID NO: 18) a phase region from the group described by nucleotides 556 to 576, 577 to 597, 598 to 618, 619 to 639, 640 to 660 and/or 661 to 681 of SEQ ID NO: 18, and s) (for the *Arabidopsis thaliana* ta-siRNA Arab TAS2 described by SEQ ID NO: 19) a phase region from the group described by nucleotides 226 to 246, 247 to 267, 268 to 288, 289 to 309, 310 to 330 and/or 331 to 351 of SEQ ID NO: 19, and t) (for the *Arabidopsis thaliana* ta-siRNA Arab TAS3 described by SEQ ID NO: 20) a phase region from the group described by nucleotides 1013 to 1033, 992 to 1012, 971 to 991, 950 to 970, 929 to 949, 908 to 928, 887 to 907 and/or 866 to 886 of SEQ ID NO: 20.

At least one of the above described phases is replaced by a sequence, which is substantially complementary to a target gene of interest and which is heterologous (i.e. is different from the sequence which it is replacing) with regard to said natural ta-siRNA. Preferably, said sequence as the same length than the phase region (in general the phase region has a length of 21 nucleotides but can also have a length of 20 to 23 nucleotides; such as 20, 21, 22, or 23 nucleotides), which is replaced. However it can be found that smaller variations in length can be tolerated. Thus the sequence replacing the phase region can be for example one, two, or three nucleotide longer or shorter than said phase region.

The replacement can be done by various techniques of cloning known to the person skilled in the art and for examples described in in Maniatis T, Fritsch E F and Sambrook J (1989) Molecular Cloning: A Laboratory Manual, 2nd Ed., Cold Spring Harbor Laboratory, Cold Spring Harbor (NY); Silhavy et al. (1984) Experiments with Gene Fusions, Cold Spring Harbor Laboratory, Cold Spring Harbor (NY); Ausubel et al. (1987) Current Protocols in Molecular Biology, Greene Publishing Assoc. and Wiley Interscience; Gelvin et al. (Eds) (1990) Plant Molecular Biology Manual; Kluwer Academic Publisher, Dordrecht, The Netherlands. Preferably, said replacement is done by a PCR-mediated mutation approach.

The sequence replacing the natural phase region shall be substantially complementary to a target gene of interest. It has been found that an absolute complementarity to the target gene is not absolutely required to achieve efficient gene silencing or attenuation. Furthermore, in some cases a partial silencing might be favorable and can be better dosaged by not using a complete complementarity. Thus preferably the sequence replacing the phase region is at least 60% (preferably at least 70% or 80%, more preferably at least 85%, more preferably at least 90%, most preferably 95%) complementary to the target gene sequence. In other words, preferably over its length (e.g., of 20 to 24 nucleotides) said sequence replacing the phase region has not more than 10, preferably not more than 5 or 8, more preferably not more than 3 or 4, even more preferably not more than 2, most preferably not more than 1 mismatch in comparison to the absolute complement to the respective target gene. The fragment of the target gene to which the sequence replacing the natural phase is complementary is chosen according to the same principles than for determining the target region for an antisense or dsRNAi approach. For example, if a high specificity is required the region is chosen is a way that there is no or little homology to other unrelated gene sequences. If silencing of a gene family is required the region is chosen in a way that it represents a conserved region for this family.

It is of special interest and inventive advantage that virtually all ta-siRNAs have more than one phase. This allows for simultaneously silencing more than one (e.g., at least 2, 3, 4, 5, 6, 7, 8) different target genes by replacing more than one of the natural phases (e.g., at least 2, 3, 4, 5, 6, 7, 8) with sequences corresponding to said different target gene of interest. Thereby coordinated silencing of multiple genes can be achieved. This of special interest when complete metabolic pathways should be modulated or resistance against more than one pathogen should be obtained. Various other promising approaches exist were modulation of multiple genes is required.

A broad variety of target genes can be modulated (e.g., silenced or attenuated) by using the method of the invention, including genes in a plant but also genes or plant infecting or eating pathogens, animals, or even human. Preferably, the target gene is selected from the group consisting of plant endogenes, transgenes, or genes from a plant infecting pathogen. More preferably the plant infecting pathogen is selected from the group consisting of viruses, fungi, bacteria, insects, and nematodes. In case of pathogens the target gene may for example be a housekeeping or other gene, which is essential for viability or proliferation of the pathogen. Thus the sequence incorporated into the ta-siRNA molecule (by replacement of a phase region) corresponds preferably to a target gene is selected from the group consisting of plant endogenes, transgenes, or genes from a plant infecting pathogen. In case of pathogens the plant infecting pathogen is preferably selected from the group consisting of viruses, fungi, bacteria, insects, and nematodes.

1.3 Replacement of the microRNA Binding Region of a ta-siRNA

Preferably, in addition to the replacement of one phase region, the microRNA binding site in said natural ta-siRNA sequence has also been replaced by another (heterogeneous) sequence, which is—preferably—substantially complementary to a small RNA sequence.

The person skilled in the art is aware of methods to identify the microRNA binding site in a ta-siRNA molecule. The term "microRNA binding site" means a short region (preferably of about 21 to 23 nucleotidest) in the ta-siRNA primary transcript substantially complementary to a miRNA. The microRNA binding site phase can be identified by computational analysis and validated by 5' RACE (see 'Prediction of miRNA targets' in Supplemental data, Allen et al., 2005, Cell 207-221).

Small RNAs are for example described in Gustafson A M, et al. (2005) Nucleic Acids Res 33, D637-40. microRNAs are described (Lau N C et al. (2001) Science 294(5543): 858-62; Comment in: Science. 2001 Oct. 26; 294(5543): 797-9). Comparative genomic approaches and computational procedure to systematically identify or predict miRNAs are described (for example the program MiRscan; Jones-Rhoades M W, Bartel D P (2004) Mol Cell 14(6): 787-99, Lim et al. (2003) Genes Dev. 7(8):991-1008; Ohler U et al. (2004) RNA 10(9):1309-22; Robins H et al. (2005) Proc Natl Acad Sci USA 102(11):4006-9. Epub 2005 Feb. 28; Rhoades M W et al. (2002) Cell 110(4):513-20; Sunkar R et al. (2005) Plant Cell 17(5):1397-411. Epub 2005 Apr. 1; Wang X J et al. (2004) Genome Biol. 5(9):R65. Epub 2004 Aug. 31). Such prediction can also be made by EST analyses (Smalheiser N R (2003) Genome Biol. 4(7):403. Epub 2003 Jun. 18). All these reference are incorporated herein by reference.

A more detailed scheme how to identify the microRNA binding site is described in Examples 2 and 3 below. For the ta-siRNA sequences specifically disclosed herein said microRNA binding sites are annotated in the sequences listing. For the specific ta-siRNA molecules disclosed herein the microRNA binding site to be replaced is selected from the group consisting of a) the binding site described by nucleotide 698 to 718 of SEQ ID NO: 1, and
b) the binding site described by nucleotide 594 to 615 of SEQ ID NO: 2, and
c) the binding site described by nucleotide 536 to 556 of SEQ ID NO: 3, and
d) the binding site described by nucleotide 601 to 622 of SEQ ID NO: 4, and
e) the binding site described by nucleotide 605 to 626 of SEQ ID NO: 5, and
f) the binding site described by nucleotide 405 to 426 of SEQ ID NO: 6, and
g) the binding site described by nucleotide 478 to 499 of SEQ ID NO: 7, and
h) the binding site described by nucleotide 492 to 512 of SEQ ID NO: 8, and
i) the binding site described by nucleotide 514 to 535 of SEQ ID NO: 9, and
j) the binding site described by nucleotide 521 to 541 of SEQ ID NO: 10, and
k) the binding site described by nucleotide 311 to 332 of SEQ ID NO: 11, and
l) the binding site described by nucleotide 382 to 403 of SEQ ID NO: 12, and
m) the binding site described by nucleotide 454 to 475 of SEQ ID NO: 13, and
n) the binding site described by nucleotide 213 to 234 of SEQ ID NO: 14, and:
o) the binding site described by nucleotide 1094 to 1115 of SEQ ID NO: 15, and
p) the binding site described by nucleotide 424 to 445 of SEQ ID NO: 16, and
q) the binding site described by nucleotide 580 to 601 of SEQ ID NO: 17, and
r) the binding site described by nucleotide 544 to 565 of SEQ ID NO: 18, and
s) the binding site described by nucleotide 214 to 235 of SEQ ID NO: 19, and
t) the binding site described by nucleotide 1022 to 1043 of SEQ ID NO: 20.

The above described microRNA binding site is replaced by a sequence, which is substantially complementary to a small RNA sequence. Said small RNA sequence is preferably capable to recognize and mediate cleavage of other RNA sequences, and is more preferably selected from the group of microRNAs, and siRNAs present in a plant.

The term small RNA means a short RNA, which is about 19-24 nucleotide long.

The term microRNA (or miRNA) means a noncoding small RNA of about 19 to 24 nucleotides. It is transcribed from an endogenous miRNA gene and the transcript forms a secondary structure of stem-loop. Such transcript, pre-miRNA, is processed by a group of enzymes including Dicer into a mature and functional form, i.e. miRNA. Plant miRNAs contain near-perfect complementarity with target sites commonly located in protein-coding regions of mRNA. After recruited into RISC complex, plant miRNAs negatively regulates gene expression by targeting and degrading mRNA, or inhibiting translation.

The term siRNA means small interefering RNA of about 19-24 nucleotides. It is derived from dsRNA transgene, transposons, virus, etc. and is processed by Dicer from long bimolecular RNA duplexes or extended hairpins. siRNA is recruited into RISC complex to target and degrade mRNA. The difference between siRNAs and miRNAs is in more detail dscribed in the art and in Table 1 below.

TABLE 1

Differences between siRNAs and miRNAs

| miRNA | siRNA |
|---|---|
| Derived from a genomic loci (i.e. endogenous gene) | Derived dsRNA transgene, transposons, virus |
| Processed from transcripts from local RNA hairpin precursor | Processed from long bimolecular RNA duplexes or extended hairpins |
| A single miRNA molecule accumulates from one arm of each miRNA hairpin precursor molecule | Many different siRNAs accumulate from both strands of siRNA precursors |
| miRNA sequences are conserved in related organisms | siRNA sequences are not conserved |
| Trans-silencing | Auto-silencing |

TABLE 1-continued

| Differences between siRNAs and miRNAs | |
|---|---|
| miRNA | siRNA |
| Spatial or temporal expression | dsRNA transgene expression |
| Post-transcriptional gene silencing or translational inhibition | Transcriptional or post-transcriptional gene silencing |

The replacement can be done by various techniques of cloning known to the person skilled in the art and for examples described in in Maniatis T, Fritsch E F and Sambrook J (1989) Molecular Cloning: A Laboratory Manual, 2nd Ed., Cold Spring Harbor Laboratory, Cold Spring Harbor (NY); Silhavy et al. (1984) Experiments with Gene Fusions, Cold Spring Harbor Laboratory, Cold Spring Harbor (NY); Ausubel et al. (1987) Current Protocols in Molecular Biology, Greene Publishing Assoc. and Wiley Interscience; Gelvin et al. (Eds) (1990) Plant Molecular Biology Manual; Kluwer Academic Publisher, Dordrecht, The Netherlands. Preferably, said replacement is done by a PCR-mediated mutation approach.

The sequence replacing the natural microRNA binding site (hereinafter also the "RNA-tag") shall be substantially complementary to a small RNA sequence. It has been found that an absolute complementarity to a small RNA sequence (e.g., an endogenous microRNA) the target gene is not absolutely required to achieve efficient binding to the target small RNA. Thus preferably the sequence replacing the microRNA binding site is at least 60% (preferably at least 70% or 80%, more preferably at least 85%, more preferably at least 90%, most preferably 95%) complementary to the small RNA molecule sequence. In other words, preferably over its length (e.g., of 20 to 24 nucleotides) said sequence replacing the microRNA binding site has not more than 10, preferably not more than 5 or 8, more preferably not more than 3 or 4, even more preferably not more than 2, most preferably not more than 1 mismatch in comparison to the absolute complement to the small RNA sequence (e.g., the microRNA). More preferably the sequence being substantially complementary to the small RNA (e.g., the microRNA) has—preferably—an identity of at least 60% or not more than 6 mismatches over the its entire sequence in comparison to the complement of a small RNA (e.g., microRNA) sequence. More preferably, said mismatches are predominantly in the region corresponding to the 3'-region of said small RNA (e.g., the microRNA). While the mismatched nucleotides may occur throughout the miRNA sequence (i.e. in any position), preferably, they are located in the region near or in the 3' region of the endogenous miRNA. The 3'-region of the endogenous miRNA is complementary to the 5'-region of the miRNA tag. Accordingly, said mismatches are preferably in the 5'-region of the miRNA-tag. It has been demonstrated, that for example, 3 mismatches plus a G::U wobble can be engineered at 3' region of miRNA without affecting its function (Mallory et al., EMBO Journal, 23:3356-3364, (2004)). Accordingly, in the most preferred embodiment the term substantially complement means that 3.5 mismatches (i.e. 3 true mismatches plus one G:U wobble counted as 0.5) can occur between the miRNA-tag and the endogenous miRNA. In this manner, a miRNA sequence can be designed to modulate the expression of any target sequence.

While the invention does not depend on RNA-tags of a particular size, the RNA-tags will have a length similar to the length of the natural microRNA binding site, which are known in the art to typically comprise between about 15 and 30 nucleotides (about 20 to about 28 nucleotides, more specifically about 21-24 nucleotides). Thus, preferably, said sequence as the same length than the microRNA binding site (in general the phase region has a length of 21 nucleotides but can also have a length of 20 to 23 nucleotides; such as 20, 21, 22 or 23 nucleotides), which is replaced. However, the sequence replacing the microRNA binding site can be longer or shorter than microRNA binding site (e.g., by for example one, two, or three nucleotides).

In one preferred embodiment the small RNA is a natural microRNA, which is more preferably selected from the group consisting of endogenous plant microRNAs and transgenic microRNAs.

It is an advantageous feature of the invention that be chosen the microRNA the silencing of the target gene can be made tissue or developmental specific. Thus, preferably, the microRNA is tissue-specific expressed, spatially-regulated, developmentally regulated, and/or regulated by biotic or abiotic stress factors.

The person skilled in the art is aware of numerous microRNAs and for methods to identify them (see above). Exemplary miRNAs are described for example by any of SEQ ID NO: 78, 79, 80, 84, 85, 86, 87, 88, 89, 90, 91, 92, 93, 94, 95, 96, 97, 98, 99, 100, 101, 102, 103, 104, 105, 106, 107, 108, 109 and/or 110 or the microRNA is derived from a precursor sequence, in particular from a precursor sequence of miR173 and/or miR390, e.g. the microRNA is derived from a sequence comprising Seq ID No. 210, 215, 216, 217, 218, 219, 220, 221, 222, and/or 223. Additional miRNAs and there expression profiles (which are useful to achieve tissue or developmental specific silencing) are described in Tables 20, 21A, 21B and 22.

By choice of either the promoter to direct expression of the chimeric ribonucleotide sequence of the invention (see below for details), but also by choice of the sequence corresponding to a small RNA (e.g., microRNA sequence) for replacement of the natural microRNA binding site the profile of silencing can be modulated e.g., in a tissue or developmental specific way. To allow for tissue or developmental-specific gene silencing or attenuation, the microRNA (to which the sequence comprised in the nucleotide sequence to be expressed is substantially complementary) is preferably not constitutively expressed, but is varying in expression in at least one parameter selected from the group consisting of tissue, special, time, development, environmental or other exogenous factors. Preferably, the microRNA is tissue-specific or -preferentially expressed, spatially-regulated, developmental regulated, and/or regulated by other factors such as biotic or abiotic stress factors.

A tissue-tissue specific—or preferentially expressed miRNA is understood herein as an miRNA which is not expressed to the same extent in all tissues of an organism at a given specific time (such expression profile may or may not change over time (e.g., during development or aging) or under other conditions (exogenous factors such as stress). Preferably, the miRNA is expressed only in one or a few tissues, while it is not expressed to a significant amount (e.g., an amount which is readily detectable by standard RNA detection methods such as Northern blot) in other tissues.

A miRNA regulated by other factors may include miRNAs which are up- or down-regulated (in one, more or all tissues) upon interaction of the organism with a factor, preferably an exogenous factor, more preferably a stress stimuli. Such stress stimuli may comprise abiotic and biotic stress factors. Given the fact that maize miR160 (see Examples for details) is a stress-induced microRNA, it is very possible that some other miRNAs are induced by a range of environmental stimuli (e.g. biotic stress, and chemicals). Using similar strategies proposed above, one can control transgene expression in response to environmental stimuli in certain tissues.

There are several approaches to identify and isolate miRNAs in various organism and tissues. For example, after total RNA is isolated from an organism or specific tissues or cell types, RNA is resolved on a denaturing 15% polyacrylamide gel. A gel fragment represents the size range of 15 to 26 nucleotides is excised, and small RNA is eluted, and recovered. Subsequently, small RNA is ligated to 5' and 3' RNA/DNA chimeric oligonucleotide adapters. Reverse transcription reaction is performed using RT primer followed by PCR with appropriate primers. PCR products are then cloned into vector for sequencing (Sunkar R and Zhu J K. (2004) The Plant Cell 16:2001:2019) Several other techniques and methods have been applied to detect miRNA in an organism or tissues such as Northern blot analysis, ribonucleases protection-based PAGE, microarray-based miRNA profiling and qRT-PCR Tagman analysis.

1.4 Production and/or Expression of the Chimeric RNA of the Invention

The chimeric ribonucleotide sequences provided herein a novel and inventive as such. Thus another embodiment of the invention relates to a chimeric ribonucleotide sequence, said chimeric ribonucleotide sequence comprising a modified ta-siRNA sequence, wherein in said sequence is modified in relation to a natural ta-siRNA sequence by at least replacing one phase region of said natural ta-siRNA by a sequence, which is substantially complementary to a target gene and which is heterologous with regard to said natural ta-siRNA.

The specific and preferred characteristics for said chimeric ribonucleotide sequence are described above and apply in full scope also for the subject matter of said chimeric ribonucleotide sequences. Preferably, the microRNA binding site in said natural ta-siRNA sequence has been replaced by a sequence, which is substantially complementary to a small RNA sequence, which is capable to recognize and mediate cleavage of other RNA sequences. More preferably, said small RNA is selected from the group of microRNAs, and siRNAs present in a plant. Preferred microRNAs to use for designing the replacement sequence are described above. Other preferred feature of the chimeric ribonucleotide sequence such as a) the natural ta-siRNA sequence, and/or
b) the modified ta-siRNA sequence, and/or
c) the phase region of said ta-siRNA, and/or
d) the microRNA binding site to be replaced, as described above for the method of the invention.

The chimeric RNA molecule can be produced and applied to the host cell or organism by various means, familiar to the person skilled in the art. The chimeric RNA molecules of the invention can be produced or synthesized by any method known in the art, e.g., using recombinant expression, enzymatic synthesis or chemical synthesis. The RNA molecules can be synthesized in vitro (e.g., using enzymatic synthesis and chemical synthesis) or in vivo (using recombinant DNA technology well known in the art).

For example, the chimeric RNA may be produced outside the eukaryotic target cell or may be produced recombinantly (e.g., by an expression construct) within the target cell. In one embodiment, the chimeric RNA molecule of the invention can be produced by enzymatic synthetic methods or chemical synthetic methods in vitro. In another embodiment, the chimeric RNA molecule may be generated in a recombinant culture, e.g., bacterial cells, isolated therefrom, and used in the methods discussed below. In another embodiment another agent (such as an expression construct or vector) generates the chimeric RNA molecule in vivo after delivery to the target cell or organism. The target cell or organism is preferably a mammalian, plant cell or animal (such as a nematode) cell or organism. For example the chimeric RNA molecule can be a) expressed from an expression construct or an expression vector in the target cell or organism, or
b) expressed from an expression construct in an in vivo or in vitro transcription system, wherein the chimeric RNA molecule is purified from said transcription system and introduced into the host cell or organism (e.g., by feeding or injection), or
c) chemical synthesis of the chimeric RNA molecule introduced into the host cell or organism (e.g., by feeding or injection).

1.4.1 Expression of the Chimeric RNA by Recombinant Expression

In one preferred embodiment the chimeric RNA molecule of the invention can be made by recombinant expression. Thus, in one embodiment of the invention the chimeric RNA is produced in the cell by an expression construct or expression vector.

In one preferred embodiment of the invention, the chimeric ribonucleotide sequence is expressed from an expression construct. For this purpose the ribonucleotide sequence might be encoded and transcribed from a corresponding DNA sequence. Thus, another embodiment of the invention relates to desoxyribonucleotide sequences encoding a chimeric ribonucleotide sequence of the invention.

Thus another embodiment of the invention relates to an expression construct comprising a promoter sequence and functionally linked thereto a nucleotide sequence encoding a chimeric ribonucleotide sequence as described above.

Preferably, the chimeric ribonucleotide sequence is directly expressed in a plant. Thus preferably the promoter is a promoter functional in a plant. The promoter operably linked to the sequence encoding the chimeric ribonucleotide sequence is preferably selected from the group consisting of constitutive promoters, tissue-specific or tissue-preferential promoters, and inducible promoters, developmentally regulated promoters, and promoters regulated by biotic or abiotic stress factors.

The chimeric RNA molecule can be made (e.g., expressed) directly in the plant cell or organism, where it can directly fulfill its function without the need of further introduction. Alternatively the chimeric RNA molecule can be expressed in another cell, optionally purified, and subsequently delivered into the target cell or organism. Thus, the RNA molecule of this invention can be made in a recombinant microorganism, e.g., bacteria and yeast or in a recombinant host cell or organism, e.g., plant or mammalian cells, and—optionally—isolated from the cultures thereof by conventional techniques. See, e.g., the techniques described in Sambrook et al, MOLECULAR CLONING, A LABORATORY MANUAL, 2nd Ed.; Cold Spring Harbor Laboratory Press, Cold Spring Harbor, N.Y., 1989, which is exemplary of laboratory manuals that detail these techniques, and the techniques described in U.S. Pat. Nos. 5,824,538; 5,877,159 and 65,643,771, incorporated herein by reference.

Where the RNA molecules of the invention are formed in vivo they are preferably produced employing an expression construct or expression vector. More preferably the expression construct or vector is comprising a nucleic acid sequence, preferably a double stranded DNA molecule, encoding at least one of the above-described chimeric RNA molecules of the invention, operably linked to a transcription regulating sequence (a promoter) which is capable to realize transcription of said nucleic acid sequence in the chosen host or target cell to produce a chimeric RNA of the invention. As discussed, a number of promoters can be used in the practice of the invention. The promoters can be selected based on the desired outcome. Thus, the nucleotide sequence for expression of the chimeric RNA can be combined with constitutive, tissue-preferred, inducible, developmental, or other promoters for expression in plants depending upon the desired outcome. Specific promoters are described below. The expression construct and its elements are preferably defined as above for the method of the invention.

The use and production of an expression construct are known in the art (see also WO 97/32016; U.S. Pat. Nos. 5,593,874, 5,698,425, 5,712,135, 5,789,214, and 5,804,693; and the references cited therein).

The expression construct can be part or a larger vector construct. Thus, another embodiment of the invention relates to an expression vector comprising an expression construct of the invention. Preferably, the expression vector is a eukaryotic expression vector. More preferably the eukaryotic expression vector is a viral vector, a plasmid vector or a binary vector. The expression construct can be inserted into the vector (preferably a plasmid vector) via a suitable restriction cleavage site. The resulting vector is first introduced into *E. coli*. Correctly transformed *E. coli* are selected, grown, and the recombinant vector is obtained by methods with which the skilled worker is familiar. Restriction analysis and sequencing can be employed for verifying the cloning step. Preferred vectors are those, which make possible a stable integration of the expression construct into the host genome. Suitable promoters and vector constructs are described in United States Patent Application No. 20040220130. A plethora of kits are commercially available for the purification of vectors (e.g., plasmids) from bacteria. For their proper use, follow the manufacturer's instructions (see, for example, EasyPrep™, FlexiPrep™, both from Pharmacia Biotech; StrataClean™, from Stratagene; and, QIAprep™, Qiagen). The isolated and purified vectors can then be further manipulated to produce other plasmids, used to transfect cells or incorporated into other vector systems (e.g., *Agrobacterium tumefaciens*) to infect and transform target cells or organism (preferably plants).

The expression construct or vector for the expression of the chimeric ribonucleotide sequence of the invention can be DNA, RNA and can be single- or double-stranded. Preferably the expression construct or vector is DNA, more preferably double-stranded DNA. More preferably the expression vector is a double-stranded, circular plasmid DNA vector. Examples of vectors (see above in the DEFINITION section for details) can be plasmids, cosmids, phages, viruses or else *Agrobacteria*. Preferably, the vector is a eukaryotic expression vector. More preferably, the eukaryotic expression vector is a viral vector or plasmid vector.

In certain embodiments, the expression constructs or vectors are episomal, e.g., and transfection is transient. In other embodiments, the expression constructs or vectors (or parts thereof such as the T-DNA region of a binary vector) are chromosomally integrated, e.g., to produce a stably transfected cell line. Preferred vectors for forming such stable cell lines are described in U.S. Pat. No. 6,025,192 and WO/9812339, which are incorporated by reference herein. Vectors for expression in *E. coli* are preferably pQE70, pQE60 and pQE-9 (QIAGEN, Inc.); pBluescript vectors, Phagescript vectors, pNH8A, pNH16a, pNH18A, pNH46A (Stratagene Cloning Systems, Inc.); ptrc99a, pKK223-3, pKK233-3, pDR540, pRIT5 (Pharmacia Biotech, Inc.).

As described above (and for specific organisms and cells below in more detail), the expression construct and vector may be introduced into organisms or cells. Another embodiment of the invention relates to a transformed cell or a non-human organism comprising a sequence (e.g., a chimeric ribonucleotide sequence or a DNA sequence encoding said sequence), an expression construct or an expression vector of the invention. Preferably, the transformed cell or non-human organism comprises said expression construct or expression vector inserted into its genome (preferably the chromosomal or plastid DNA). More preferably, the transformed cell or non-human organism is selected from the group of mammalian, bacterial (prokaryotic), fungal, nematode or plant cells and organism.

Preferred prokaryotes are mainly bacteria such as bacteria of the genus *Escherichia, Corynebacterium, Bacillus, Clostridium, Proionibacterium, Butyrivibrio, Eubacterium, Lactobacillus, Erwinia, Agrobacterium, Flavobacterium, Alcaligenes, Phaeodactylum, Colpidium, Mortierella, Entomophthora, Mucor, Crypthecodinium* or Cyanobacteria, for example of the genus *Synechocystis*. Microorganisms which are preferred are mainly those which are capable of infecting plants and thus of transferring the constructs according to the invention. Preferred microorganisms are those of the genus *Agrobacterium* and in particular the species *Agrobacterium tumefaciens* and *rhizogenes*.

The plant may be a monocot, dicot or gymnosperm; the animal may be a vertebrate or invertebrate. Preferred animal and plant organisms are specified above in the DEFINITION section. Preferred fungi are *Aspergillus, Trichoderma, Ashbya, Neurospora, Fusarium, Beauveria* or further fungi described in Indian Chem. Engr. Section B. Vol 37, No 1, 2 (1995), page 15, Table 6. Especially preferred is the filamentous Hemiascomycete *Ashbya gossypii*. Preferred yeasts are *Candida, Saccharomyces, Hansenula* or *Pichia*, especially preferred are *Saccharomyces cerevisiae* or *Pichia pastoris* (ATCC Accession No. 201178). Especially preferred animal organisms are nematodes.

Preferred as organisms are plant organisms. Preferred plants are selected in particular from among crop plants. Most preferred are a) Plants which are suitable for oil production such as, for example, oilseed rape, sunflower, sesame, safflower (*Carthamus tinctorius*), olive tree, soybean, maize, peanut, castor-oil plant, oil palm, wheat, cacao shrub, or various nut species such as, for example, walnut, coconut or almond. Especially preferred among these, in turn, are dicotyledonous plants, in particular oilseed rape, soybean and sunflower.
b) Plants, which serve for the production of starch, such as, for example, maize, wheat or potato.
c) Plants, which are used as foodstuffs and/or feeding stuffs and/or useful plant and in which a resistance to pathogens would be advantageous such as, for example, barley, rye, rice, potato, cotton, flax, or linseed.
d) Plants, which can serve for the production of fine chemicals such as, for example, vitamins and/or carotenoids such as, for example, oilseed rape.

Plant varieties may be excluded, particularly registrable plant varieties according to Plant Breeders Rights. It is noted that a plant need not be considered a "plant variety" simply because it contains stably within its genome a transgene, introduced into a cell of the plant or an ancestor thereof. In addition to a plant, the present invention provides any clone of such a plant, seed, selfed or hybrid progeny and descendants, and any part or propagule of any of these, such as cuttings and seed, which may be used in reproduction or propagation, sexual or asexual. Also encompassed by the invention is a plant which is a sexually or asexually propagated offspring, clone or descendant of such a plant, or any part or propagule of said plant, off-spring, clone or descendant. Genetically modified plants according to the invention, which can be consumed by humans or animals, can also be used as food or feedstuffs, for example directly or following processing known in the art. The present invention also provides for parts of the organism especially plants, particularly reproductive or storage parts. Plant parts, without limitation, include seed, endosperm, ovule, pollen, roots, tubers, stems, leaves, stalks, fruit, berries, nuts, bark, pods, seeds and flowers. In a particularly preferred embodiment of the present invention, the plant part is a seed.

1.4.2 Introduction of the Chimeric RNA into Cells and Organism

The chimeric RNA of the invention or its delivery or production agents (e.g., expression constructs or vectors) (hereinafter together the "RNA agent") can be introduced into an organism or a cell (e.g., a plant) in various ways with which the skilled worker is familiar. "To introduce" is to be understood in the broad sense and comprises, for the purposes of the present invention, all those methods which are suitable for directly or indirectly introducing, into an organism or a cell, compartment, tissue, organ or seed of same, a RNA agent of the invention, or generating it/them therein. The introduction can bring about the transient presence of a RNA agent, or else a stable presence. The RNA agents are described above in detail.

The RNA agent is typically is introduced or administered in an amount that allows delivery of at least one copy per cell. Higher amounts (for example at least 5, 10, 100, 500 or 1,000 copies per cell) can, if appropriate, affect a more efficient phenotype (e.g., higher expression or higher suppression of the target genes). The amount of RNA agent administered to a cell, tissue, or organism depends on the nature of the cell, tissue, or organism, the nature of the target gene, and the nature of the RNA agent, and can readily be optimized to obtain the desired level of expression or inhibition.

Preferably at least about 100 molecules, preferably at least about 1,000, more preferably at least about 10,000 of the RNA agent, most preferably at least about 100,000 of the RNA agent are introduced. In the case of administration of RNA agent to a cell culture or to cells in tissue, by methods other than injection, for example by soaking, electroporation, or lipid-mediated transfection, the cells are preferably exposed to similar levels of RNA agent in the medium.

For examples the RNA agent may be introduced into cells via transformation, transfection, injection, projection, conjugation, endocytosis, and phagocytosis. Preferred method for introduction comprise but are not limited to:

a) methods of the direct or physical introduction of the chimeric RNA molecule of the invention into the target cell or organism, and
b) methods of the indirect introduction of chimeric RNA of the invention into the target cell or organism (e.g., by a first introduction of an expression construct and a subsequent intracellular expression).

1.4.2.1 Direct and Physical Introduction of RNA into Target Cells or Organism

In case the chimeric RNA of the invention (or an RNA agent) is produced outside the target cell or organism, it can be contacted with (i.e., brought into contact with, also referred to herein as administered or delivered to) and taken up by one or more cell or the target organism (preferably human, pathogen or plant cells or organisms). The contact may be in vitro, e.g., in a test tube or culture dish, (and may or may not be introduced into a subject) or in vivo, e.g., in a subject such as a mammalian, pathogen or plant subject. The pathogen is preferably a nematode.

The chimeric RNA of the invention (or an RNA agent) may be directly introduced into the cell (i.e., intracellularly); or introduced extracellularly into a cavity, interstitial space, into the circulation of an organism, introduced orally, or may be introduced by bathing an organism in a solution containing the chimeric RNA of the invention (or an RNA agent). Methods for oral introduction include direct mixing of RNA with food of the organism, as well as engineered approaches in which a species that is used as food is engineered to express a chimeric RNA of the invention (or an RNA agent), then fed to the organism to be affected.

Physical methods of introducing nucleic acids include injection of a solution of the chimeric RNA of the invention (or an RNA agent) directly into the cell or extracellular injection into the organism. For example, in the case of an embryo or a cell, the chimeric RNA of the invention (or an RNA agent) is conveniently administered by microinjection; other methods of introducing nucleic acids into a cell include bombardment by particles covered by the chimeric RNA of the invention (or an RNA agent), soaking the cell or organism in a solution of the chimeric RNA of the invention (or an RNA agent), electroporation of cell membranes in the presence of the chimeric RNA of the invention (or an RNA agent), liposome-mediated delivery of chimeric RNA of the invention (or an RNA agent) and transfection mediated by chemicals such as calcium phosphate.

The chimeric RNA of the invention (or an RNA agent) agent may be introduced along with components that enhance RNA uptake by the cell, or otherwise increase its functionality. Delivery into cells can be enhanced by suitable art recognized methods including calcium phosphate, DMSO, glycerol or dextran, electroporation, or by transfection, e.g., using cationic, anionic, or neutral lipid compositions or liposomes using methods known in the art (see e.g., WO 90/14074; WO 91/16024; WO 91/17424; U.S. Pat. No. 4,897,355; Bergan et al. 1993. Nucleic Acids Research. 21:3567). Also polyamine or polycation conjugates using compounds such as polylysine, protamine, or N1, N12-bis (ethyl) spermine (see, e.g., Bartzatt, R. et al. 1989. Biotechnol. Appl. Biochem. 11:133; Wagner E. et al. 1992. Proc. Natl. Acad. Sci. 88:4255) can be employed. In the case of a cell culture or tissue explant, the cells are conveniently incubated in a solution containing the chimeric RNA of the invention (or an RNA agent) or lipid-mediated transfection; in the case of a whole animal or plant, the chimeric RNA of the invention (or an RNA agent) is conveniently introduced by injection or perfusion into a cavity or interstitial space of an organism, or systemically via oral, topical, parenteral (including subcutaneous, intramuscular and intravenous administration), vaginal, rectal, intranasal, ophthalmic, or intraperitoneal administration.

In addition, the chimeric RNA of the invention (or an RNA agent) can be administered via an implantable extended release device. Methods for oral introduction include direct mixing of RNA with food of the organism, as well as engineered approaches in which a species that is used as food is engineered to express RNA, then fed to the organism to be affected. The chimeric RNA of the invention (or an RNA agent) may be sprayed onto a plant or a plant may be genetically engineered to express the RNA in an amount sufficient to kill some or all of a pathogen known to infect the plant.

1.4.2.2 Indirect Introduction of RNA

Alternatively, the RNA agent can be supplied to a cell indirectly by introducing (e.g., by transformation or transfection) one or more expression constructs or expression vectors that encode the chimeric RNA molecule of the invention. The expression of the chimeric RNA of the invention can be transient or—for example after integration into the genome (for example using selection markers) of the organism—stable. Preferably for pharmaceutical application, the RA agent is introduced transiently, and not stably integrated into the genome. Preferably for applications in plants, the chimeric RNA expression system is integrated stably into the genome—for example the chromosomal DNA or the DNA of the organelles (for example the plastids (e.g., chloroplasts), mitochondria and the like)—of a cell. Integration into the chromosomal DNA is preferred.

Expression constructs and vectors are generally described above (see DEFINITION section and section 1.3.1). Preferred expression constructs are described in more detailed below for the specific applications the composition and methods of the present invention. Methods for supplying a cell with RNA by introducing an expression construct or vector from which it can be transcribed are set forth in WO 99/32619. Principally also all the methods for direct introduction of RNA molecules into cells as described above can be employed for introduction of the nucleic acid molecules resembling the expression construct or vector.

1.5 Plant Transformation & Expression Technology

A chimeric RNA of the invention can be expressed within a plant cell using conventional recombinant DNA technology. Generally, this involves inserting a nucleotide sequence encoding the chimeric RNA of the invention into an expression construct or expression vector using standard cloning procedures known in the art.

1.5.1. Requirements for Construction of Plant Expression Constructs

The expression construct or expression construct of the invention comprises one or more genetic control sequences (or regulatory sequences) operably linked to a nucleic acid sequence encoding the chimeric RNA of the invention. These genetic control sequences regulate expression of the chimeric RNA in host cells. Genetic control sequences are described, for example, in "Goeddel; Gene Expression Technology: Methods in Enzymology 185, Academic Press, San Diego, Calif. (1990)" or "Gruber and Crosby, in: Methods in Plant Molecular Biology and Biotechnolgy, CRC Press, Boca Raton, Fla., eds.: Glick and Thompson, Chapter 7, 89-108" and the references cited therein. Sequences intended for expression in plants are first operatively linked to a suitable promoter functional in plants. Such expression constructs optionally comprise further sequences required or selected for the expression of the transgene. Such sequences include, but are not restricted to, transcription terminators, extraneous sequences to enhance expression. These expression constructs are easily transferred to the plant transformation vectors described infra.

1.5.1.1. Promoters

The nucleic acid sequence conferring the expression of the chimeric RNA of the invention preferably comprises or is operably linked to a plant-specific promoter. The term "plant-specific promoter" means principally any promoter which is capable of governing the expression of genes, in particular foreign nucleic acid sequences or genes, in plants or plant parts, plant cells, plant tissues, plant cultures. In this context, the expression specificity of said plant-specific promoter can be for example constitutive, tissue-specific, inducible or development-specific. The following are preferred:

1.5.1.1.1 Constitutive Promoters

Where expression of a gene in all tissues of a transgenic plant or other organism is desired, one can use a "constitutive" promoter, which is generally active under most environmental conditions and states of development or cell differentiation. Useful promoters for plants also include those obtained from Ti- or Ri-plasmids, from plant cells, plant viruses or other organisms whose promoters are found to be functional in plants. Bacterial promoters that function in plants, and thus are suitable for use in the methods of the invention include the octopine synthetase promoter, the nopaline synthase promoter, and the mannopine synthetase promoter. The promoter controlling expression of the chimeric RNA of the invention (and/or selection marker) can be constitutive. Suitable constitutive promoters for use in plants include, for example, the cauliflower mosaic virus (CaMV) 35S transcription initiation region (Franck et al. (1980) Cell 21:285-294; Odell et al. (1985) Nature 313:810-812; Shewmaker et al. (1985) Virology 140:281-288; Gardner et al. (1986) Plant Mol Biol 6:221-228), the 19S transcription initiation region (U.S. Pat. No. 5,352,605 and WO 84/02913), and region VI promoters, the 1'- or 2'-promoter derived from T-DNA of *Agrobacterium tumefaciens*, and other promoters active in plant cells that are known to those of skill in the art. Other suitable promoters include the full-length transcript promoter from Figwort mosaic virus, actin promoters (e.g., the rice actin promoter; McElroy et al. (1990) Plant Cell 2: 163-171), histone promoters, tubulin promoters, or the mannopine synthase promoter (MAS). Other constitutive plant promoters include various ubiquitin or poly-ubiquitin promoters (Sun and Callis (1997) Plant J 11(5): 1017-1027, Cristensen et al. (1992) Plant Mol Biol 18:675-689; Christensen et al. (1989) Plant Mol. Biol. 12: 619-632; Bruce et al. (1989) Proc Natl Acad Sci USA 86:9692-9696; Holtorf et al. (1995) Plant Mol Biol 29:637-649), the mas, Mac or DoubleMac promoters (U.S. Pat. No. 5,106,739; Comai et al. (1990) Plant Mol Biol 15:373-381), the ubiquitin promoter (Holtorf et al. (1995) Plant Mol Biol 29:637-649), Rubisco small subunit (SSU) promoter (U.S. Pat. No. 4,962,028), the legumin B promoter (GenBank Acc. No. X03677), the promoter of the nopaline synthase (NOS) from *Agrobacterium*, the TR dual promoter, the octopine synthase (OCS) promoter from *Agrobacterium*, the Smas promoter, the cinnamyl alcohol dehydrogenase promoter (U.S. Pat. No. 5,683,439), the promoters of the vacuolar ATPase subunits, the pEMU promoter (Last et al. (1991) Theor. Appl. Genet. 81, 581-588); the MAS promoter (Velten et al. (1984) EMBO J. 3(12): 2723-2730), the maize H3 histone promoter (Lepetit et al. (1992) Mol. Gen. Genet. 231: 276-285; Atanassova et al. (1992) Plant J 2(3): 291-300), 洞 -conglycinin promoter, the phaseolin promoter, the ADH promoter, and heatshock promoters, the nitrilase promoter from *Arabidopsis thaliana* (WO 03/008596; GenBank Acc. No.: U38846, nucleotides 3,862 to 5,325 or else 5342), promoter of a proline-rich protein from wheat (WO 91/13991), the promoter of the *Pisum sativum* ptxA gene, and other transcription initiation regions from various plant genes known to those of skill in the art.

However, it has to be noted that because of the high efficiency of the chimeric RNA of the invention, the method of the current invention does not rely on the presence of strong promoter regions to drive the transcriptional production of the chimeric RNA. In other words, a whole range of promoters, particularly plant expressible promoters, is available to direct the transcription.

1.5.1.1.2 Tissue-Specific Promoters

Preferred promoters can be employed which regulate expression in only one or some tissues or organs, such as leaves, roots, fruit, seeds, anthers, ovaries, pollen, meristem, stems or flowers, or parts thereof. For example, the tissue-specific ES promoter from tomato is particularly useful for directing gene expression so that a desired gene product is located in fruits (see, e.g., Lincoln et al. (1988) Proc Natl Acad Sci USA 84:2793-2797; Deikman et al. (1988) EMBO J. 7:3315-3320; Deikman et al. (1992) Plant Physiol 100: 2013-2017). Suitable seed specific promoters include those derived from the following genes: MAC1 from maize (Sheridan et al. (1996) Genetics 142:1009-1020), Cat3 from maize (GenBank No. L05934), the gene encoding oleosin 18 kD from maize (GenBank No. J05212) viviparous-1 from *Arabidopsis* (Genbank Acc.-No. U93215), the gene encoding oleosin from *Arabidopsis* (Genbank Acc.-No. Z17657), Atmycl from *Arabidopsis* (Urao et al. (1996) Plant Mol Biol 32:571-576), the 2S seed storage protein gene family from *Arabidopsis* (Conceicao et al. (1994) Plant 5:493-505) the gene encoding oleosin 20 kD from *Brassica napus* (GenBank No. M63985), napin from *Brassica napus* (GenBank No. J02798, Joseffson et al. (1987) J Biol Chem 262:12196-12201), the napin gene family (e.g., from *Brassica napus*; Sjodahl et al. (1995) Planta 197:264-271), U.S. Pat. No. 5,608,152; Stalberg et al. (1996) Planta 199:515-519), the gene encoding the 2S storage protein from *Brassica napus* (Dasgupta et al. (1993) Gene 133: 301-302), the genes encoding oleosin A (Genbank Acc.-No. U09118) and oleosin B (Genbank No. U09119) from soybean, the gene encoding low molecular weight sulphur rich protein from soybean (Choi et al. (1995) Mol Gen Genet. 246:266-268), the phaseolin gene (U.S. Pat. No. 5,504,200, Bustos et al. (1989) Plant Cell 1(9):839-53; Murai et al. (1983) Science 23: 476-482; Sengupta-Gopalan et al. (1985) Proc. Nat'l Acad. Sci. USA 82:3320-3324 (1985)), the 2S albumin gene, the legumin gene (Shirsat et al. (1989) Mol Gen Genet. 215(2): 326-331), the USP (unknown seed protein) gene, the sucrose binding protein gene (WO 00/26388), the legumin B4 gene (LeB4; Fiedler et al. (1995) Biotechnology (NY) 13(10): 1090-1093), Baumlein et al. (1992) Plant J 2(2):233-239; Baumlein et al. (1991a) Mol Gen Genet. 225(3):459-467; Baumlein et al. (1991b) Mol Gen Genet. 225:121-128), the *Arabidopsis* oleosin gene (WO 98/45461), the *Brassica* Bce4 gene (WO 91/13980), genes encoding the "high-molecular-weight glutenin" (HMWG), gliadin, branching enzyme, ADP-glucose pyrophosphatase (AGPase) or starch synthase. Furthermore preferred promoters are those which enable seed-specific expression in monocots such as maize, barley, wheat, rye, rice and the like. Promoters which may advantageously be employed are the promoter of the Ipt2 or Ipt1 gene (WO 95/15389, WO 95/23230) or the promoters described in WO 99/16890 (promoters of the hordein gene, the glutelin gene, the oryzin gene, the prolamine gene, the gliadin gene, the zein gene, the kasirin gene or the secalin gene). Further preferred are a leaf-specific and light-induced promoter such as that from cab or Rubisco (Timko et al. (1985) Nature 318: 579-582; Simpson et al. (1985) EMBO J. 4:2723-2729); an anther-specific promoter such as that from LAT52 (Twell et al. (1989) Mol Gen Genet. 217:240-245); a pollen-specific promoter such as that from Zml3 (Guerrero et al. (1993) Mol Gen Genet. 224:161-168); and a microspore-preferred promoter such as that from apg (Twell et al. (1983) Sex. Plant Reprod. 6:217-224). Further suitable promoters are, for example, specific promoters for tubers, storage roots or roots such as, for example, the class I patatin promoter (B33), the potato cathepsin D inhibitor promoter, the starch synthase (GBSS1) promoter or the sporamin promoter, and fruit-specific promoters such as, for example, the tomato fruit-specific promoter (EP-A 409 625). Promoters which are furthermore suitable are those which ensure leaf-specific expression. Promoters which may be mentioned are the potato cytosolic FBPase promoter (WO 98/18940), the Rubisco (ribulose-1,5-bisphosphate carboxylase) SSU (small subunit) promoter or the potato ST-LSI promoter (Stockhaus et al. (1989) EMBO J. 8(9):2445-2451). Other preferred promoters are those which govern expression in seeds and plant embryos. Further suitable promoters are, for example, fruit-maturation-specific promoters such as, for example, the tomato fruit-maturation-specific promoter (WO 94/21794), flower-specific promoters such as, for example, the phytoene synthase promoter (WO 92/16635) or the promoter of the P1-rr gene (WO 98/22593) or another node-specific promoter as described in EP-A 249676 may be used advantageously. The promoter may also be a pith-specific promoter, such as the promoter isolated from a plant TrpA gene as described in WO 93/07278.

Further preferred promoter are described in the following table.

TABLE 1B

Potential promoter candidates driving ta-siRNA expression

| Promoter | 5'-UTR | IME*-Intron | Terminator | Tissue Specificity | Reference |
|---|---|---|---|---|---|
| *Oryza sativa* Caffeoyl-CoA-O-methyltransferase | own | *Zea mays* Ubiquitin | Own | all (constitutive) | WO2006/084868 |
| *Oryza sativa* Caffeoyl-CoA-O-methyltransferase | own | *Zea mays* Ubiquitin | NOS | root (kernel, pollen) | WO2006/084868 |
| *Oryza sativa* Caffeoyl-CoA-O-methyltransferase | own | *Oryza sativa* BPSI.1 | NOS | Embryo | PCT/EP2006/060513 |
| *Oryza sativa* C-8,7-sterol-isomerase | own | *Zea mays* Ubiquitin | NOS | root, kernel | WO2006/084868 |
| *Oryza sativa* C-8,7-sterol-isomerase | own | *Oryza sativa* BPSI.1 | NOS | root, kernel | PCT/EP2006/060513 |

TABLE 1B-continued

| Potential promoter candidates driving ta-siRNA expression | | | | | |
|---|---|---|---|---|---|
| Promoter | 5'-UTR | IME*-Intron | Terminator | Tissue Specificity | Reference |
| *Zea mays* Hydroxyproline-rich glycoprotein (HRGP) | own | *Zea mays* Ubiquitin | Own | root, silk (kernel: embryo) | WO2006/084868 |
| *Zea mays* Hydroxyproline-rich glycoprotein (HRGP) | own | *Oryza sativa* BPSI.1 | Own | root, silk, aleuron layer | PCT/EP2006/060513 |
| *Zea mays* Lactate-dehydrogenase | own | *Zea mays* Ubiquitin | NOS or own | root, kernel | WO2006/084868 |
| *Zea mays* Lactate-dehydrogenase | own | *Oryza sativa* BPSI.1 | NOS | Outside layer of embryo | PCT/EP2006/060513 |
| *Zea mays* Lactate-dehydrogenase | own | *Oryza sativa* BPSI.5 | NOS | endosperm and aleuron layer, mainly at the top side of the kernel | PCT/EP2006/060513 |
| Chloroplast protein 12 like protein | own | *Zea mays* Ubiquitin | NOS | Leaf, endosperm | WO2006/084868 |
| Chloroplast protein 12 like protein | own | *Oryza sativa* BPSI.1 | NOS | Leaf | PCT/EP2006/060513 |
| *Zea mays* Globulin1 | own | N/A | NOS | Embryo (predominantly in scutellum), aleuron layer | Genetics, 150: 863-872 (1998) |
| *Zea mays* Globulin1 | own | *Oryza sativa* BPSI.1 | NOS | Embryo, aleuron layer | PCT/EP2006/060513 |
| *Oryza sativa* V-ATPase | Own | *Oryza sativa* BPSI.1 | NOS | Root-preferable | PCT/EP2006/060513 |
| *Zea mays* Ubiquitin | Own | *Zea mays* Ubiquitin | NOS | Ubiquitous, constitutive | Plant Physiology 100: 1503-1507 (1992) |
| *Oryza sativa* Actin1 | Own | *Orysa sativa* Actin 1 | NOS | Ubiquitous, constitutive | The Plant Cell, 2: 163-171 |
| *Oryza sativa* LEA | Own | *Orysa sativa* BPSI.1 | NOS | embryo | PCT/EP2006/060513 |
| *Agrobacterium tumefaciens* Super | Own | N/A | NOS | Embryo during germination | PF56540 |
| *Petroselinum crispum* Ubiquitin | Own | N/A | NOS | Ubiquitous, constitutive | WO03/102198 |
| UK398 | Own | N/A | NOS | Mesophyll or epidermal-preferable | EP01666599, US20060156429; |

*IME stands for intron-mediated enhancement

For preferred pattern and level of expression in monocot plants the promoter constructs is preferably functional linked to one an intron-mediated enhancement (IME)-conferring intron in 5'UTR and/or to an appropriate 3'UTR, preferably as indicated in above table.

1.5.1.1.3 Chemically Inducible Promoters

An expression constructs may also contain a chemically inducible promoter (review article: Gatz et al. (1997) Annu Rev Plant Physiol Plant Mol Biol 48:89-108), by means of which the expression of the nucleic acid sequence encoding the chimeric RNA of the invention in the plant can be controlled at a particular point in time. Such promoters such as, for example, a salicylic acid-inducible promoter (WO 95/19443), a benzenesulfonamide-inducible promoter (EP 0 388 186), a tetracycline-inducible promoter (Gatz et al. (1991) Mol Gen Genetics 227:229-237), an abscisic acid-inducible promoter EP 0 335 528) or an ethanol-cyclohexanone-inducible promoter (WO 93/21334) can likewise be used. Also suitable is the promoter of the glutathione-S transferase isoform II gene (GST-II-27), which can be activated by exogenously applied safeners such as, for example, N,N-diallyl-2,2-dichloroacetamide (WO 93/01294) and which is operable in a large number of tissues of both monocotyledonous and dicotyledonous. Further exemplary inducible promoters that can be utilized in the instant invention include that from the ACE1 system which responds to copper (Mett et al. PNAS 90: 4567-4571 (1993)); or the In2 promoter from maize which responds to benzenesulfonamide herbicide safeners (Hershey et al. (1991) Mol Gen Genetics 227:229-237; Gatz et al. (1994)

Mol Gen Genetics 243:32-38). A promoter that responds to an inducing agent to which plants do not normally respond can be utilized. An exemplary inducible promoter is the inducible promoter from a steroid hormone gene, the transcriptional activity of which is induced by a glucocorticosteroid hormone (Schena et al. (1991) Proc Nat'l Acad Sci USA 88:10421). Other preferred promoters are promoters induced by biotic or abiotic stress, such as, for example, the pathogen-inducible promoter of the PRP1 gene (Ward et al. (1993) Plant Mol Biol 22:361-366), the tomato heat-inducible hsp80 promoter (U.S. Pat. No. 5,187,267), the potato chill-inducible alpha-amylase promoter (WO 96/12814) or the wound-induced pinll promoter (EP-A1 0 375 091).

1.5.1.1.4 Stress- or Pathogen-Inducible Promoters

One can use a promoter that directs expression environmental control. Examples of environmental conditions that may affect transcription by inducible promoters include biotic or abiotic stress factors or other environmental conditions, for example, pathogen attack, anaerobic conditions, ethylene or the presence of light.

Promoters inducible by biotic or abiotic stress include but are not limited to the pathogen-inducible promoter of the PRP1 gene (Ward et al. (1993) Plant Mol Biol 22:361-366), the heat-inducible hsp70 or hsp80 promoter from tomato (U.S. Pat. No. 5,187,267), the chill-inducible alpha-amylase promoter from potato (WO 96/12814), the light-inducible PPDK promoter or the wounding-inducible pinII promoter (EP375091). Pathogen-inducible promoters comprise those of genes which are induced as the result of attack by pathogens such as, for example, genes of PR proteins, SAR proteins, b-1,3-glucanase, chitinase and the like (for example Redolfi et al. (1983) Neth J Plant Pathol 89:245-254; Uknes, et al. (1992) The Plant Cell 4:645-656; Van Loon (1985) Plant Mol Viral 4:111-116; Marineau et al. (1987) Plant Mol Biol 9:335-342; Matton et al. (1987) Molecular Plant-Microbe Interactions 2:325-342; Somssich et al. (1986) Proc Natl Acad Sci USA 83:2427-2430; Somssich et al. (1988) Mol Gen Genetics 2:93-98; Chen et al. (1996) Plant J 10:955-966; Zhang and Sing (1994) Proc Natl Acad Sci USA 91:2507-2511; Warner, et al. (1993) Plant J 3:191-201; Siebertz et al. (1989) Plant Cell 1:961-968 (1989)). Also comprised are wounding-inducible promoters such as that of the pinII gene (Ryan (1990) Ann Rev Phytopath 28:425-449; Duan et al. (1996) Nat Biotech 14:494-498), of the wun1 and wun2 gene (U.S. Pat. No. 5,428,148), of the win1 and wing gene (Stanford et al. (1989) Mol Gen Genet. 215:200-208), of systemin (McGurl et al. (1992) Science 225:1570-1573), of the WIP1 gene (Rohmeier et al. (1993) Plant Mol Biol 22:783-792; Eckelkamp et al. (1993) FEBS Letters 323:73-76), of the MPI gene (Corderok et al. (1994) The Plant J 6(2):141-150) and the like.

1.5.1.1.5 Development-Dependent Promoters

Further preferred promoters are, for example, fruit-maturation-specific promoters, such as, for example, the fruit-maturation-specific promoter from tomato (WO 94/21794, EP 409 625). Development-dependent promoters include partly the tissue-specific promoters described above since individual tissues are, naturally, formed as a function of the development. A development-regulated promoter is, inter alia, described (Baerson and Lamppa (1993) Plant Mol Biol 22(2):255-67).

1.5.1.1.6 Other Suitable Promoter and Promoter Elements

Promoters may also encompass further promoters, promoter elements or minimal promoters capable of modifying the expression-governing characteristics. Thus, for example, the tissue-specific expression may take place in addition as a function of certain stress factors, owing to genetic control sequences. Such elements are, for example, described for water stress, abscisic acid (Lam and Chua (1991) J Biol Chem 266(26):17131-17135) and heat stress (Schoffl et al. (1989) Molecular & General Genetics 217(2-3):246-53).

1.5.1.2 Other Genetic Control Elements

Genetic control sequences are furthermore to be understood as those permitting removal of the inserted sequences from the genome. Methods based on the cre/lox (Dale and Ow (1991) Proc Nat'l Acad Sci USA 88:10558-10562; Sauer (1998) Methods 14(4):381-92; Odell et al. (1990) Mol Gen Genet. 223:369-378), FLP/FRT (Lysnik et al. (1993) NAR 21:969-975), or Ac/Ds system (Lawson et al. (1994) Mol Gen Genet. 245:608-615; Wader et al. (1987) in TOMATO TECHNOLOGY 189-198 (Alan R. Liss, Inc.); U.S. Pat. No. 5,225,341; Baker et al. (1987) EMBO J. 6: 1547-1554) permit a—if appropriate tissue-specific and/or inducible—removal of a specific DNA sequence from the genome of the host organism. Control sequences may in this context mean the specific flanking sequences (e.g., lox sequences), which later allow removal (e.g., by means of cre recombinase).

1.5.1.2.1 Transcriptional Terminators

A variety of transcriptional terminators are available for use in expression constructs. These are responsible for the termination of transcription beyond the transgene and its correct polyadenylation. Appropriate transcriptional terminators are those that are known to function in plants and include the CaMV 35S terminator, the tml terminator, the OCS (octopin synthase) terminator and the NOS (nopalin synthase) terminator and the pea rbcS E9 terminator. These can be used in both monocotyledons and dicotyledons.

1.5.1.2.2 Sequences for the Enhancement or Regulation of Expression

Genetic control sequences furthermore also comprise the 5'-untranslated regions, introns or noncoding 3' region of genes, such as, for example, the actin-1 intron, or the Adh1-S introns 1, 2 and 6 (general reference: The Maize Handbook, Chapter 116, Freeling and Walbot, Eds., Springer, New York (1994)). It has been demonstrated that they can play a significant role in the regulation of gene expression and have been shown to enhance expression, particularly in monocotyledonous cells. Thus, it has been demonstrated that 5'-untranslated sequences can enhance the transient expression of heterologous genes. An example which may be mentioned of such translation enhancers is the tobacco mosaic virus 5' leader sequence (Gallie et al. (1987) Nucl Acids Res 15:8693-8711) and the like. They can furthermore promote tissue specificity (Rouster J et al. (1998) Plant J 15:435-440).

1.5.2. Construction of Plant Transformation Vectors

The expression construct for expression of the chimeric RNA molecule of the invention is preferably comprised in an expression vector. Numerous transformation vectors for plant transformation are known to the person skilled in the plant transformation arts. The selection of vector will depend upon the preferred transformation technique and the target species for transformation.

1.5.2.1 Vector Elements

Expression constructs and the vectors derived therefrom may comprise further functional elements. The term functional element is to be understood in the broad sense and means all those elements, which have an effect on the generation, multiplication or function of the expression constructs, vectors or transgenic organisms according to the invention. The following may be mentioned by way of example, but not by limitation:

1.5.2.1.1. Selectable Marker Genes

Selectable marker genes are useful to select and separate successfully transformed cells. Preferably, within the method of the invention one marker may be employed for selection in a prokaryotic host, while another marker may be employed for selection in a eukaryotic host, particularly the plant species host. The marker may confer resistance against a biocide, such as antibiotics, toxins, heavy metals, or the like, or may function by complementation, imparting prototrophy to an auxotrophic host. Preferred selectable marker genes for plants may include but are not be limited to the following:

1.5.2.1.1.1. Negative Selection Markers

Negative selection markers confer a resistance to a biocidal compound such as a metabolic inhibitor (e.g., 2-deoxyglucose-6-phosphate, WO 98/45456), antibiotics (e.g., kanamycin, G 418, bleomycin or hygromycin) or herbicides (e.g., phosphinothricin or glyphosate). Especially preferred negative selection markers are those which confer resistance to herbicides. These markers can be used—beside their function as a marker—to confer a herbicide resistance trait to the resulting plant. Examples, which may be mentioned, are:

- Phosphinothricin acetyltransferases (PAT; also named Bialophos resistance; bar; de Block et al. (1987) EMBO J. 6:2513-2518; EP 0 333 033; U.S. Pat. No. 4,975,374)
- 5-enolpyruvylshikimate-3-phosphate synthase (EPSPS; U.S. Pat. No. 5,633,435) or glyphosate oxidoreductase gene (U.S. Pat. No. 5,463,175) conferring resistance to Glyphosate (N-phosphonomethyl glycine) (Shah et al. (1986) Science 233: 478)
- Glyphosate degrading enzymes (Glyphosate oxidoreductase; gox),
- Dalapon inactivating dehalogenases (deh)
- Sulfonylurea- and imidazolinone-inactivating acetolactate synthases (for example mutated ALS variants with, for example, the S4 and/or Hra mutation
- Bromoxynil degrading nitrilases (bxn)
- Kanamycin- or. G418-resistance genes (NPTII; NPTI) coding e.g., for neomycin phos-photransferases (Fraley et al. (1983) Proc Natl Acad Sci USA 80:4803), which expresses an enzyme conferring resistance to the antibiotic kanamycin and the related antibiotics neomycin, paromomycin, gentamicin, and G418,
- 2-Deoxyglucose-6-phosphate phosphatase (DOGR1-Gene product; WO 98/45456; EP 0 807 836) conferring resistance against 2-desoxyglucose (Randez-Gil et al. (1995) Yeast 11:1233-1240)
- Hygromycin phosphotransferase (HPT), which mediates resistance to hygromycin (Vanden Elzen et al. (1985) Plant Mol. Biol. 5:299).
- Dihydrofolate reductase (Eichholtz et al. (1987) Somatic Cell and Molecular Genetics 13, 67-76)

Additional negative selectable marker genes of bacterial origin that confer resistance to antibiotics include the aadA gene, which confers resistance to the antibiotic spectinomycin, gentamycin acetyl transferase, streptomycin phosphotransferase (SPT), aminoglycoside-3-adenyl transferase and the bleomycin resistance determinant (Svab et al. (1990) Plant Mol. Biol. 14:197; Jones et al. (1987) Mol. Gen. Genet. 210:86; Hille et al. (1986) Plant Mol. Biol. 7:171 (1986); Hayford et al. (1988) Plant Physiol. 86:1216).

Especially preferred are negative selection markers which confer resistance against the toxic effects imposed by D-amino acids like e.g., D-alanine and D-serine (WO 03/060133; Erikson et al. (2004) Nat. Biotechnol. 22(4): 455-8). Especially preferred as negative selection marker in this contest are the daol gene (EC: 1.4. 3.3: GenBank Acc.-No.: U60066) from the yeast *Rhodotorula* gracilis (Rhodosporidium toruloides) and the *E. coli* gene dsdA (D-serine dehydratase (D-serine deaminase) [EC: 4.3. 1.18; GenBank Acc.-No.: J01603). Depending on the employed D-amino acid the D-amino acid oxidase markers can be employed as dual function marker offering negative selection (e.g., when combined with for example D-alanine or D-serine) or counter selection (e.g., when combined with D-leucine or D-isoleucine).

1.5.2.1.1.2. Positive Selection Marker

Positive selection markers are conferring a growth advantage to a transformed plant in comparison with a non-transformed one. Genes like isopentenyltransferase from *Agrobacterium tumefaciens* (strain: PO22; Genbank Acc.-No.: AB025109) may—as a key enzyme of the cytokinin biosynthesis—facilitate regeneration of transformed plants (e.g., by selection on cytokinin-free medium). Corresponding selection methods are described (Ebinuma et al. (2000a) Proc Natl Acad Sci USA 94:2117-2121; Ebinuma et al. (2000b) Selection of Marker-free transgenic plants using the oncogenes (ipt, rol A, B, C) of *Agrobacterium* as selectable markers, In Molecular Biology of Woody Plants. Kluwer Academic Publishers). Additional positive selection markers, which confer a growth advantage to a transformed plant in comparison with a non-transformed one, are described e.g., in EP-A 0 601 092. Growth stimulation selection markers may include (but shall not be limited to) 洞-Glucuronidase (in combination with e.g., cytokinin glucuronide), mannose-6-phosphate isomerase (in combination with mannose), UDP-galactose-4-epimerase (in combination with e.g., galactose), wherein mannose-6-phosphate isomerase in combination with mannose is especially preferred.

1.5.2.1.1.3. Counter Selection Marker

Counter selection markers are especially suitable to select organisms with defined deleted sequences comprising said marker (Koprek et al. (1999) Plant J 19(6): 719-726). Examples for counter selection marker comprise thymidine kinases (TK), cytosine deaminases (Gleave et al. (1999) Plant Mol. Biol. 40(2):223-35; Perera et al. (1993) Plant Mol. Biol. 23(4): 793-799; Stougaard (1993) Plant J 3:755-761), cytochrom P450 proteins (Koprek et al. (1999) Plant J 19(6): 719-726), haloalkan dehalogenases (Naested (1999) Plant J 18:571-576), iaaH gene products (Sundaresan et al. (1995) Gene Develop 9: 1797-1810), cytosine deaminase codA (Schlaman and Hooykaas (1997) Plant J 11:1377-1385), or tms2 gene products (Fedoroff and Smith (1993) Plant J 3:273-289).

1.5.2.1.2. Reporter Genes

Reporter genes encode readily quantifiable proteins and, via their color or enzyme activity, make possible an assessment of the transformation efficacy, the site of expression or the time of expression. Very especially preferred in this context are genes encoding reporter proteins (Schenborn and Groskreutz (1999) Mol Biotechnol 13(1):29-44) such as the green fluorescent protein (GFP) (Haseloff et al. (1997) Proc Natl Acad Sci USA 94(6):2122-2127; Sheen et al. (1995) Plant J 8(5):777-784; Reichel et al. (1996) Proc Natl Acad Sci USA 93(12):5888-5893; Chui et al. (1996) Curr Biol 6:325-330; Leffel et al. (1997) Biotechniques. 23(5):912-8; Tian et al. (1997) Plant Cell Rep 16:267-271; WO 97/41228), chloramphenicol transferase, a luciferase (Millar et al. (1992) Plant Mol Biol Rep 10:324-414; Ow et al. (1986) Science 234:856-859), the aequorin gene (Prasher et al. (1985) Biochem Biophys Res Commun 126(3):1259-

1268), 湐-galactosidase, R locus gene (encoding a protein which regulates the production of anthocyanin pigments (red coloring) in plant tissue and thus makes possible the direct analysis of the promoter activity without addition of further auxiliary substances or chromogenic substrates (Dellaporta et al. (1988) In: Chromosome Structure and Function: Impact of New Concepts, 18th Stadler Genetics Symposium, 11:263-282; Ludwig et al. (1990) Science 247:449), with 湐-D-glucuronidase (GUS) being very especially preferred (Jefferson (1987b) Plant Mol. Bio. Rep., 5:387-405; Jefferson et al. (1987) EMBO J. 6:3901-3907). 湐-glucuronidase (GUS) expression is detected by a blue color on incubation of the tissue with 5-bromo-4-chloro-3-indolyl-湐-D-glucuronic acid, bacterial luciferase (LUX) expression is detected by light emission; firefly luciferase (LUC) expression is detected by light emission after incubation with luciferin; and galactosidase expression is detected by a bright blue color after the tissue was stained with 5-bromo-4-chloro-3-indolyl-湐-D-galactopyranoside. Reporter genes may also be used as scorable markers as alternatives to antibiotic resistance markers. Such markers are used to detect the presence or to measure the level of expression of the transferred gene. The use of scorable markers in plants to identify or tag genetically modified cells works well only when efficiency of modification of the cell is high.

1.5.2.1.3. Origins of Replication.

Origins of replication which ensure amplification of the expression constructs or vectors according to the invention in, for example, *E. coli*. Examples which may be mentioned are ORI (origin of DNA replication), the pBR322 ori or the P15A ori (Maniatis T, Fritsch E F and Sambrook J (1989) Molecular Cloning: A Laboratory Manual, 2nd Ed., Cold Spring Harbor Laboratory, Cold Spring Harbor (NY)). Additional examples for replication systems functional in *E. coli*, are ColE1, pSC101, pACYC184, or the like. In addition to or in place of the *E. coli* replication system, a broad host range replication system may be employed, such as the replication systems of the P-1 Incompatibility plasmids; e.g., pRK290. These plasmids are particularly effective with armed and disarmed Ti-plasmids for transfer of T-DNA to the plant host.

1.5.2.1.4. Elements, which are Necessary for *Agrobacterium*-Mediated Transformation, Such as, for Example, the Right and/or—Optionally—Left Border of the T-DNA or the Vir Region.

1.5.2.1.5. Multiple Cloning Sites (MCS) to Enable and Facilitate the Insertion of One or More Nucleic Acid Sequences.

1.5.2.2 Vectors for Plant Transformation 1.5.2.2.1 Vectors Suitable for *Agrobacterium* Transformation If *Agrobacteria* are used, the expression construct is to be integrated into specific plasmids vectors, either into a shuttle, or intermediate, vector or into a binary vector: If a Ti or Ri plasmid is to be used for the transformation, at least the right border, but in most cases the right and the left border, of the Ti or Ri plasmid T-DNA is flanking the region with the expression construct to be introduced into the plant genome. It is preferred to use binary vectors for the *Agrobacterium* transformation. Binary vectors are capable of replicating both in *E. coli* and in *Agrobacterium*. They preferably comprise a selection marker gene and a linker or polylinker flanked by the right and—optionally—left T-DNA border sequence. They can be transformed directly into *Agrobacterium* (Holsters et al. (1978) Mol Gen Genet 163:181-187). A selection marker gene may be included in the vector which permits a selection of transformed *Agrobacteria* (e.g., the nptIII gene). The *Agrobacterium*, which acts as host organism in this case, should already comprise a disarmed (i.e., non-oncogenic) plasmid with the vir region. This region is required for transferring the T-DNA to the plant cell. The use of T-DNA for the transformation of plant cells has been studied and described extensively (EP 120 516; Hoekema, In: The Binary Plant Vector System, Offsetdrukkerij Kanters B. V., Alblasserdam, Chapter V; An et al. (1985) EMBO J. 4:277-287). A variety of binary vectors are known and available for transformation using *Agrobacterium*, such as, for example, pBI101.2 or pBIN19 (Clontech Laboratories, Inc. USA; Bevan et al. (1984) Nucl Acids Res 12:8711), pBinAR, pPZP200 or pPTV.

1.5.2.2.2 Vectors Suitable for Non-Agrobacterium Transformation

Transformation without the use of *Agrobacterium tumefaciens* circumvents the requirement for T-DNA sequences in the chosen transformation vector and consequently vectors lacking these sequences can be utilized in addition to vectors such as the ones described above which contain T-DNA sequences. Transformation techniques that do not rely on *Agrobacterium* include transformation via particle bombardment, protoplast uptake (e.g. PEG and electroporation) and microinjection. The choice of vector depends largely on the preferred selection for the species being transformed. Typical vectors suitable for non-*Agrobacterium* transformation include pCIB3064, pSOG19, and pSOG35. (See, for example, U.S. Pat. No. 5,639,949).

1.5.3. Transformation Techniques 1.5.3.1 General Techniques

Once an expression construct or expression vector of the invention has be established, it can be transformed into a plant cell. A variety of methods for introducing nucleic acid sequences (e.g., vectors) into the genome of plants and for the regeneration of plants from plant tissues or plant cells are known (Plant Molecular Biology and Biotechnology (CRC Press, Boca Raton, Fla.), chapter 6/7, pp. 71-119 (1993); White F F (1993) Vectors for Gene Transfer in Higher Plants; in: Transgenic Plants, vol. 1, Engineering and Utilization, Ed.: Kung and Wu R, Academic Press, 15-38; Jenes B et al. (1993) Techniques for Gene Transfer, in: Transgenic Plants, vol. 1, Engineering and Utilization, Ed.: Kung and R. Wu, Academic Press, pp. 128-143; Potrykus (1991) Annu Rev Plant Physiol Plant Molec Biol 42:205-225; Halford N G, Shewry P R (2000) Br Med Bull 56(1):62-73).

Transformation methods may include direct and indirect methods of transformation. Suitable direct methods include polyethylene glycol induced DNA uptake, liposome-mediated transformation (U.S. Pat. No. 4,536,475), biolistic methods using the gene gun ("particle bombardment"; Fromm M E et al. (1990) Bio/Technology. 8(9):833-9; Gordon-Kamm et al. (1990) Plant Cell 2:603), electroporation, incubation of dry embryos in DNA-comprising solution, and microinjection. In the case of these direct transformation methods, the plasmid used need not meet any particular requirements. Simple plasmids, such as those of the pUC series, pBR322, M13 mp series, pACYC184 and the like can be used. If intact plants are to be regenerated from the transformed cells, an additional selectable marker gene is preferably located on the plasmid. The direct transformation techniques are equally suitable for dicotyledonous and monocotyledonous plants.

Transformation can also be carried out by bacterial infection by means of *Agrobacterium* (for example EP 0 116 718), viral infection by means of viral vectors (EP 0 067 553; U.S. Pat. No. 4,407,956; WO 95/34668; WO 93/03161) or by means of pollen (EP 0 270 356; WO 85/01856; U.S.

Pat. No. 4,684,611). *Agrobacterium* based transformation techniques (especially for dicotyledonous plants) are well known in the art. The *Agrobacterium* strain (e.g., *Agrobacterium tumefaciens* or *Agrobacterium rhizogenes*) comprises a plasmid (Ti or Ri plasmid) and a T-DNA element which is transferred to the plant following infection with *Agrobacterium*. The T-DNA (transferred DNA) is integrated into the genome of the plant cell. The T-DNA may be localized on the Ri- or Ti-plasmid or is separately comprised in a so-called binary vector. Methods for the *Agrobacterium*-mediated transformation are described, for example, in Horsch R B et al. (1985) Science 225:1229f. The *Agrobacterium*-mediated transformation is best suited to dicotyledonous plants but has also been adopted to monocotyledonous plants. The transformation of plants by *Agrobacteria* is described (White F F, Vectors for Gene Transfer in Higher Plants; in Transgenic Plants, Vol. 1, Engineering and Utilization, edited by S. D. Kung and R. Wu, Academic Press, 1993, pp. 15-38; Jenes B et al. (1993) Techniques for Gene Transfer, in: Transgenic Plants, Vol. 1, Engineering and Utilization, edited by S. D. Kung and R. Wu, Academic Press, pp. 128-143; Potrykus (1991) Annu Rev Plant Physiol Plant Molec Biol 42:205-225).

Transformation may result in transient or stable transformation and expression. Although a nucleotide sequence of the present invention can be inserted into any plant and plant cell falling within these broad classes (as specified above in the DEFINITION section), it is particularly useful in crop plant cells.

Various tissues are suitable as starting material (explant) for the *Agrobacterium*-mediated transformation process including but not limited to callus (U.S. Pat. No. 5,591,616; EP-A1604 662), immature embryos (EP-A1672 752), pollen (U.S. Pat. No. 54,929,300), shoot apex (U.S. Pat. No. 5,164,310), or in planta transformation (U.S. Pat. No. 5,994, 624). The method and material described herein can be combined with virtually all *Agrobacterium* mediated transformation methods known in the art. Preferred combinations include—but are not limited—to the following starting materials and methods:

TABLE 2

Plant Transformation Methods

| Variety | Material/Citation |
|---|---|
| Monocotyledonous plants: | Immature embryos (EP-A1 672 752)<br>Callus (EP-A1 604 662)<br>Embryogenic callus (U.S. Pat. No. 6,074,877)<br>Inflorescence (U.S. Pat. No. 6,037,522)<br>Flower (in planta) (WO 01/12828) |
| Banana | U.S. Pat. No. 5,792,935; EP-A1 731 632;<br>U.S. Pat. No. 6,133,035 |
| Barley | WO 99/04618 |
| Maize | U.S. Pat. No. 5,177,010; U.S. Pat. No. 5,987,840 |
| Pineapple | U.S. Pat. No. 5,952,543; WO 01/33943 |
| Rice | EP-A1 897 013; U.S. Pat. No. 6,215,051; WO 01/12828 |
| Wheat | AU-B 738 153; EP-A1 856 060 |
| Beans | U.S. Pat. No. 5,169,770; EP-A1 397 687 |
| *Brassica* | U.S. Pat. No. 5,188,958; EP-A1 270 615;<br>EP-A1 1,009,845 |
| Cacao | U.S. Pat. No. 6,150,587 |
| Citrus | U.S. Pat. No. 6,103,955 |
| Coffee | AU 729 635 |
| Cotton | U.S. Pat. No. 5,004,863; EP-A1 270 355;<br>U.S. Pat. No. 5,846,797; EP-A1 1,183,377;<br>EP-A1 1,050,334; EP-A1 1,197,579;<br>EP-A1 1,159,436<br>Pollen transformation (U.S. Pat. No. 5,929,300)<br>In planta transformation (U.S. Pat. No. 5,994,624) |

TABLE 2-continued

Plant Transformation Methods

| Variety | Material/Citation |
|---|---|
| Pea | U.S. Pat. No. 5,286,635 |
| Pepper | U.S. Pat. No. 5,262,316 |
| Poplar | U.S. Pat. No. 4,795,855 |
| Soybean | cotyledonary node of germinated soybean seedlings<br>shoot apex (U.S. Pat. No. 5,164,310)<br>axillary meristematic tissue of primary, or higher leaf node of about 7 days germinated soybean seedlings organogenic callus cultures<br>dehydrated embryo axes<br>U.S. Pat. No. 5,376,543; EP-A1 397 687;<br>U.S. Pat. No. 5,416,011; U.S. Pat. No. 5,968,830;<br>U.S. Pat. No. 5,563,055; U.S. Pat. No. 5,959,179;<br>EP-A1 652 965; EP-A1 1,141,346 |
| Sugarbeet | EP-A1 517 833; WO 01/42480 |
| Tomato | U.S. Pat. No. 5,565,347 |

1.5.3.2. Plastid Transformation

In another preferred embodiment, a nucleotide sequence of the present invention (preferably an expression construct for the chimeric RNA molecule of the invention) is directly transformed into the plastid genome. Plastid expression, in which genes are inserted by homologous recombination into the several thousand copies of the circular plastid genome present in each plant cell, takes advantage of the enormous copy number advantage over nuclear-expressed genes to permit high expression levels. In a preferred embodiment, the nucleotide sequence is inserted into a plastid targeting vector and transformed into the plastid genome of a desired plant host. Plants homoplasmic for plastid genomes containing the nucleotide sequence are obtained, and are preferentially capable of high expression of the nucleotide sequence.

Plastid transformation technology is for example extensively described in U.S. Pat. Nos. 5,451,513, 5,545,817, 5,545,818, and 5,877,462 in PCT application no. WO 95/16783 and WO 97/32977, and in McBride et al. (1994) Proc. Natl. Acad. Sci. USA 91, 7301-7305, all incorporated herein by reference in their entirety. The basic technique for plastid transformation involves introducing regions of cloned plastid DNA flanking a selectable marker together with the nucleotide sequence into a suitable target tissue, e.g., using biolistic or protoplast transformation (e.g., calcium chloride or PEG mediated transformation). The 1 to 1.5 kb flanking regions, termed targeting sequences, facilitate homologous recombination with the plastid genome and thus allow the replacement or modification of specific regions of the plastome. Initially, point mutations in the chloroplast 16S rRNA and rps12 genes conferring resistance to spectinomycin and/or streptomycin are utilized as selectable markers for transformation (Svab et al. (1990) Proc. Natl. Acad. Sci. USA 87, 8526-8530; Staub et al. (1992) Plant Cell 4, 39-45). The presence of cloning sites between these markers allowed creation of a plastid targeting vector for introduction of foreign genes (Staub et al. (1993) EMBO J. 12, 601-606). Substantial increases in transformation frequency are obtained by replacement of the recessive rRNA or r-protein antibiotic resistance genes with a dominant selectable marker, the bacterial aadA gene encoding the spectinomycin-detoxifying enzyme aminoglycoside-3'-adenyltransferase (Svab et al. (1993) Proc. Natl. Acad. Sc. USA 90, 913-917). Other selectable markers useful for plastid transformation are known in the art and encompassed within the scope of the invention.

For using the methods according to the invention, the skilled worker has available well-known tools, such as expression vectors with promoters which are suitable for plants, and methods for the transformation and regeneration of plants.

1.5.4. Selection and Regeneration Techniques

To select cells which have successfully undergone transformation, it is preferred to introduce a selectable marker which confers, to the cells which have successfully undergone transformation, a resistance to a biocide (for example a herbicide), a metabolism inhibitor such as 2-deoxyglucose-6-phosphate (WO 98/45456) or an antibiotic. The selection marker permits the transformed cells to be selected from untransformed cells. (McCormick et al. (1986) Plant Cell Reports 5:81-84). Suitable selection markers are described above.

Transgenic plants can be regenerated in the known manner from the transformed cells. The resulting plantlets can be planted and grown in the customary manner. Preferably, two or more generations should be cultured to ensure that the genomic integration is stable and hereditary. Suitable methods are described (Fennell et al. (1992) Plant Cell Rep. 11: 567-570; Stoeger et al (1995) Plant Cell Rep. 14:273-278; Jahne et al. (1994) Theor Appl Genet. 89:525-533).

Additional embodiments of the invention relate to transformed seeds and plants of the plant of the inventions and the use of said plants, seeds, and plant parts in the agro-industry and/or in the production of food, feed, industrial products, oil, nutritiants, and other valuable products. Preferably, these other embodiment of the invention relates to a) transformed seed of such a plant, b) a method for breeding other plants using said plant, c) use of said plant in breeding or agriculture, d) use of said plant to produce chemicals, food or feed products.

2. Applications of Chimeric RNA of the Invention

The invention has broad opportunities of application, preferably in the field of plants. It is especially useful to obtain silencing of multiple genes, optionally in a tissue-specific or developmentally regulated fashion.

The chimeric RNA molecules of the invention, the expression constructs and the expression vectors for their expression, and the transgenic organism comprising said molecules could be utilized in gene silencing (i.e. to attenuate, reduce or suppress expression of target genes in target cells or organism).

Any gene being expressed in a cell (preferably a plant cell) can be targeted. A gene that is expressed in the cell is one that is transcribed to yield RNA (e.g., mRNA) and, optionally, a protein. The target gene can be an endogenous gene or an exogenous or foreign gene (i.e., a transgene or a pathogen gene). For example, a transgene that is present in the genome of a cell as a result of genomic integration of the viral delivery construct can be regulated using chimeric RNA according to the invention. The foreign gene can be integrated into the host genome (preferably the chromosomal DNA), or it may be present on an extra-chromosomal genetic construct such as a plasmid or a cosmid. For example, the target gene may be present in the genome of the cell into which the chimeric RNA is introduced, or in the genome of a pathogen, such as a virus, a bacterium, a fungus or a protozoan, which is capable of infecting such organism or cell.

Preferably the target gene is a eukaryotic gene, more preferably a mammalian, nematode, fungal or plant gene. Preferably the target gene is an endogenous gene of the cell or a heterologous gene relative to the genome of the cell, such as a pathogen gene. Preferably, the gene of a pathogen is from a pathogen capable to infect an eukaryotic organism. Most preferably, said pathogen is selected from the group of virus, bacteria, fungi and nematodes. By expressing the chimeric RNA of the invention in plants, not only plant genes can function as target genes for gene silencing, but also genes of organisms which infect plants or eat plants (as food or feed). Thus the target gene can also be a gene of an animal or plant pathogen. The target gene is preferably selected from the group consisting of genes in a plant or of a plant infecting pathogen.

Preferably, the expression of the target gene (as measured by the expressed RNA or protein) is reduced, inhibited or attenuated by at least 10%, preferably at least 30% or 40%, preferably at least 50% or 60%, more preferably at least 80%, most preferably at least 90% or 95%. The levels of target products such as transcripts or proteins may be decreased throughout an organism such as a plant or mammal, or such decrease in target products may be localized in one or more specific organs or tissues of the organism. For example, the levels of products may be decreased in one or more of the tissues and organs of a plant including without limitation: roots, tubers, stems, leaves, stalks, fruit, berries, nuts, bark, pods, seeds and flowers. A preferred organ is a seed of a plant.

2.1 Applications in Plant Biotechnology

The subsequent application of compositions and methods according to the invention may be mentioned by way of example, but not by limitation.

The method according to the invention is preferably employed for the purposes of plant biotechnology for generating plants with advantageous properties. Thus, the suitability of the plants or their seeds as foodstuff or feeding stuff can be improved, for example via a modification of the compositions and/or the content of metabolites, in particular proteins, oils, vitamins and/or starch. Also, growth rate, yield or resistance to biotic or abiotic stress factors can be increased. The subsequent applications in the field of plant biotechnology are particularly advantageous.

A further aspect of the invention relates to a transgenic plant or plant cell comprising a chimeric RNA of the invention, or an expression construct or expression vector for expression of said chimeric RNA. Another embodiment relates to the use of the transgenic organism according to the invention (e.g., the transgenic plant) and of the cells, cell cultures, parts—such as, for example, in the case of transgenic plant organisms roots, leaves and the like—derived from them and transgenic propagation material such as seeds or fruits for the production of foodstuffs or feeding stuffs, pharmaceuticals or fine chemicals, such as, for example, enzymes, vitamins, amino acids, sugars, fatty acids, natural or synthetic flavorings, aromas and colorants. Especially preferred is the production of triacylglycerides, lipids, oils, fatty acids, starches, tocopherols and tocotrienols and carotenoids. Genetically modified plants according to the invention which can be consumed by humans and animals can also be used as foodstuffs or feeding stuffs, for example directly or after undergoing a processing which is known per se.

A broad variety of target genes can be modulated by using the method of the invention, including genes in a plant but also genes or plant infecting or eating pathogens, animals, or even human. Preferably, the target gene is selected from the group consisting of plant endogenes, transgenes, or genes from a plant infecting pathogen. More preferably the plant infecting pathogen is selected from the group consisting of viruses, fungi, bacteria, insects, and nematodes. In case of pathogens the target gene may for example be a housekeeping or other gene, which is essential for viability or proliferation of the pathogen. The attenuation or silencing of the target gene may have various effects (also depending on the nature of the target gene). Preferably, silencing or attenuating said target gene results in an agronomic trait. Said agronomic trait may preferably be selected from the group consisting of disease resistance, herbicide resistance, resistance against biotic or abiotic stress, and improved nutritional value. In this context, the target gene may be for example preferably selected from the group consisting of genes involved in the synthesis and/or degradation of proteins, peptides, fatty acids, lipids, waxes, oils, starches, sugars, carbohydrates, flavors, odors, toxins, carotenoids, hormones, polymers, flavinoids, storage proteins, phenolic acids, alkaloids, lignins, tannins, celluloses, glycoproteins, and glycolipids. All these sequences are well known to the person skilled in the art an can be easily obtained from DNA data bases (e.g., GenBank).

3.1.2 Plant Target Genes for Gene Silencing with Enhanced Specificity

DNA may be introduced into plants for the purpose of expressing RNA transcripts that function to affect plant phenotype yet are not translated into protein. Two examples are antisense RNA and RNA with ribozyme activity. Both may serve possible functions in reducing or eliminating expression of native or introduced plant genes.

Genes may be constructed or isolated, which when transcribed, produce antisense RNA or double-stranded RNA that is complementary to all or part(s) of a targeted messenger RNA(s). The antisense RNA reduces production of the polypeptide product of the messenger RNA. The polypeptide product may be any protein encoded by the plant genome. The aforementioned genes will be referred to as antisense genes. An antisense gene may thus be introduced into a plant by transformation methods to produce a novel transgenic plant with reduced expression of a selected protein of interest. For example, the protein may be an enzyme that catalyzes a reaction in the plant. Reduction of the enzyme activity may reduce or eliminate products of the reaction which include any enzymatically synthesized compound in the plant such as fatty acids, amino acids, carbohydrates, nucleic acids and the like. Alternatively, the protein may be a storage protein, such as a zein, or a structural protein, the decreased expression of which may lead to changes in seed amino acid composition or plant morphological changes respectively. The possibilities cited above are provided only by way of example and do not represent the full range of applications.

Expression of antisense-RNA or double-stranded RNA by one of the expression cassettes of the invention is especially preferred. Also expression of sense RNA can be employed for gene silencing (co-suppression). This RNA is preferably a non-translatable RNA. Gene regulation by double-stranded RNA ("double-stranded RNA interference"; dsRNAi) is well known in the arte and described for various organism including plants (e.g., Matzke 2000; Fire A et al 1998; WO 99/32619; WO 99/53050; WO 00/68a74; WO 00/44914; WO 00/44895; WO 00/49035; WO 00/63364).

Genes may also be constructed or isolated, which when transcribed produce RNA enzymes, or ribozymes, which can act as endoribonucleases and catalyze the cleavage of RNA molecules with selected sequences. The cleavage of selected messenger RNA's can result in the reduced production of their encoded polypeptide products. These genes may be used to prepare novel transgenic plants which possess them. The transgenic plants may possess reduced levels of polypeptides including but not limited to the polypeptides cited above that may be affected by antisense RNA.

It is also possible that genes may be introduced to produce novel transgenic plants which have reduced expression of a native gene product by a mechanism of cosuppression. It has been demonstrated in tobacco, tomato, and petunia (Goring 1991; Smith 1990; Napoli 1990; van der Krol 1990) that expression of the sense transcript of a native gene will reduce or eliminate expression of the native gene in a manner similar to that observed for antisense genes. The introduced gene may encode all or part of the targeted native protein but its translation may not be required for reduction of levels of that native protein.

The possible target genes stated are to be understood by way of example, but not by limitation:

3.1.2.1 Improved Protection Against Abiotic Stress Factors (Heat, Chill, Drought, Increased Moisture, Environmental Toxins, Uv Radiation).

It is preferred to reduce the expression of genes, which are involved in stress reactions.

For this application either a miRNA-tag, which allows for specific silencing in sensitive tissue (young seedling, embryo) or a miRNA-tag corresponding to an miRNA, which is endogenously suppressed by the stress factor is preferred to be employed for designing the miRNA-tag.

3.1.2.2 Modification of the Composition and/or the Content of Fatty Acids, Lipids or Oils A modification of the fatty acid contents or the fatty acid composition, preferably in an oil crop such as oilseed rape or sunflower, can be achieved, for example, by reducing the gene expression of fatty acid biosynthesis genes, preferably those selected from the group consisting of genes encoding acetyl transacylases, acyl transport proteins ("acyl carrier protein"), desaturases such as stearyl desaturases or microsomal D12-desaturases, in particular Fad2-1 genes, malonyl transacylase, 河-ketoacyl-ACP synthetases, 3-keto-ACP reductases, enoyl-ACP hydrases, thioesterases such as acyl-ACP thioesterases, enoyl-ACP reductases. Various further advantageous approaches for modifying the lipid composition are described (Shure M et al. (1983) Cell 35:225-233; Preiss et al. (1987) Tailoring Genes for Crop Improvement (Bruening et al., eds.), Plenum Press, S.133-152; Gupta et al. (1988) Plant Mol. Biol. 10:215-224; Olive et al. (1989) Plant Mol Biol 12:525-538; Bhattacharyya et al. (1990) Cell 60:155-122; Dunwell J M (2000) J Exp Botany 51Spec No:487-96; Brar D S et al. (1996) Biotech Genet. Eng Rev 13:167-79; Kishore G M and Somerville C R (1993) Curr Opin Biotech 4(2):152-8). Preferred are, in particular, Fad2 genes (for example those described by Genbank Acc. No.: AF124360 (*Brassica carinata*), AF042841 (*Brassica rapa*), L26296 (*Arabidopsis thaliana*), A65102 (*Corylus avellana*)). Further advantageous genes and methods for modifying the lipid content are described, for example, in U.S. Pat. No. 5,530,192 and WO 94/18337. An elevated lipid content can also be achieved by reducing the starch content, for example as the result of the reduced expression of enzymes of the carbohydrate metabolism (for example ADP-glucose pyrophosphorylases).

For this application either a miRNA-tag, which allows for specific silencing in seeds is preferred for designing the miRNA-tag. For example, maize miR167 is expressed predominantly in seeds, use of miR167 binding site (complementary to miR167) in ta-siRNA primary transcript could enhance seed-specific silencing.

3.1.2.3 Modification of the Carbohydrate Composition

A modification of the carbohydrate composition can be achieved for example by reducing the gene expression of carbohydrate metabolism genes or of carbohydrate biosynthesis genes, for example genes of the biosynthesis of amylose, pectins, cellulose or cell-wall carbohydrates. A multiplicity of cellular processes (maturation, storability, starch composition or starch content and the like) can thereby be influenced in an advantageous manner. Target genes which may be mentioned by way of example, but not by limitation, are phosphorylases, starch synthetases, Q-enzymes, sucrose-6-phosphate synthetases, sucrose-6-phosphate phosphatases, ADP-glucose pyrophosphorylases, branching enzymes, debranching enzymes and various amylases. The corresponding genes are described (Dunwell J M (2000) J Exp Botany 51Spec No:487-96; Brar D S et al. (1996) Biotech Genet Eng Rev 13:167-79; Kishore G M and Somerville C R (1993) Curr Opin Biotech 4(2):152-8). Advantageous genes for influencing the carbohydrate metabolism—in particular starch biosynthesis—are described in WO 92/11375, WO 92/11376, U.S. Pat. No. 5,365,016 and WO 95/07355.

For this application either a miRNA-tag, which allows for enhanced specific expression in seeds is preferred for designing the miRNA-tag. For example, maize miR167 is expressed predominantly in seeds, use of miR167 binding site (complementary to miR167) in ta-siRNA primary transcript could enhance seed-specific silencing.

3.1.2.4 Modification of the Color or Pigmentation

A modification of the color or pigmentation, preferably of ornamentals, can be achieved for example by reducing the gene expression of flavonoid biosynthesis genes such as, for example, the genes of chalcone synthases, chalcone isomerases, phenylalanine ammonia lyases, dehydrokaempferol(flavone) hydroxylases such as flavanone 3-hydroxylases or flavanone 2-hydroxylases, dihydroflavonol reductases, dihydroflavanol 2-hydroxylases, flavonoid 3'-hydroxylases, flavonoid 5'-hydroxylases, flavonoid glycosyltransferases (for example glucosyltransferases such as UDPG:flavonoid 3-O-glucosyltransferases, UDPG:flavonol 7-O-glucosyltransferases or rhamnosyltransferases), flavonoid methyltransferases (such as, for example, SAM: anthocyanidin-3-(p-coumaroyl)rutinoside-5-glucoside-3',5'-O-methyltransferases) and flavonoid acyltransferases (Hahlbrock (1981) Biochemistry of Plants, Vol. 7, Conn (Ed.); Weiring and de Vlaming (1984) "Petunia", KC Sink (Ed.), Springer-Verlag, New York). Particularly suitable are the sequences described in EP-A1522 880.

For this application either a miRNA-tag, which allows for enhanced specific expression in flowers and its part is preferred for designing the miRNA-tag. For example, *Arabidopsis* At miR319b is predominantly expressed in flowers, use of miR319b binding site (complementary to At miR319b) in a ta-siRNA primary transcript can enhance specific expression of gene-of-interest in flowers.

3.1.2.5. Reduction of the Storage Protein Content

The reduction of the gene expression of genes encoding storage proteins (SP hereinbelow) has a large number of advantages such as, for example, the reduction of the allergenic potential or modification in the composition or quantity of other metabolites. Storage proteins are described, inter alia, in EP-A 0 591 530, WO 87/47731, WO 98/26064, EP-A 0 620 281; Kohno-Murase J et al. (1994) Plant Mol Biol 26(4): 1115-1124. SP serves for the storage of carbon, nitrogen and sulfur, which are required for the rapid heterotrophic growth in the germination of seeds or pollen. In most cases, they have no enzymatic activity. SP are synthesized in the embryo only during seed development and, in this process, accumulate firstly in protein storage vacuoles (PSV) of differently differentiated cells in the embryo or endosperm. Storage proteins can be classified into subgroups, as the function of further characteristic properties, such as, for example, their sedimentation coefficient or the solubility in different solutions (water, saline, alcohol). The sedimentation coefficient can be determined by means of ultracentrifugation in the manner with which the skilled worker is familiar (for example as described in Correia J J (2000) Methods in Enzymology 321:81-100). In total, four large gene families for storage proteins can be assigned, owing to their sequences: 2S albumins (napin-like), 7S globulins (phaseolin-like), 11S/12S globulins (legumin/cruciferin-like) and the zein prolamins. 2S albumins are found widely in seeds of dicots, including important commercial plant families such as Fabaceae (for example soybean), Brassicaceae (for example oilseed rape), Euphorbiaceae (for example castor-oil plant) or Asteraceae (for example sunflower). 2S albumins are compact globular proteins with conserved cysteine residues which frequently form heterodimers. 7S globulins occur in trimeric form and comprise no cysteine residues. After their synthesis, they are cleaved into smaller fragments and glycosylated, as is the case with the 2S albumins. Despite differences in polypeptide size, the different 7S globulins are highly conserved and can probably be traced to a shared precursor protein, as is the case with the 2S albumins. Only small amounts of the 7S globulins are found in monocots. In dicots, they always amount to less than the 11S/12S globulins. 11S/12S globulins constitute the main fraction of the storage proteins in dicots, in addition to the 2S albumins. The high degree of similarity of the different 11S globulins from different plant genera, in turn, allow the conclusion of a shared precursor protein in the course of evolution. The storage protein is preferably selected from the classes of the 2S albumins (napin-like), 7S globulins (phaseolin-like), 11S/12S globulins (legumin/cruciferin-like) or zein prolamins. Especially preferred 11S/12S globulins comprise preferably 11S globulins from oilseed rape, soybean and *Arabidopsis*, sunflower, linseed, sesame, safflower, olive tree, soybean or various nut species. Especially preferred zein prolamins preferably comprise those from monocotyledonous plants, in particular maize, rice, oats, barley or wheat.

For this application either a miRNA-tag, which allows for enhanced specific expression in seeds is preferred for designing the miRNA-tag. For example, maize miR167 is expressed predominantly in seeds, use of miR167 binding site (complementary to miR167) in ta-siRNA primary transcript could enhance seed-specific silencing.

3.1.2.6. Obtaining a Resistance to Plant Pathogens

The methods and means of the invention will be especially suited for obtaining pathogen (e.g., virus or nematode) resistance, in eukaryotic cells or organisms, particularly in plant cells and plants. It is expected that the chimeric RNA molecules (or the dsRNA molecules derived therefrom) produced by transcription in a host organism (e.g., a plant), can spread systemically throughout the organism. Thus it is possible to reduce the phenotypic expression of a nucleic acid in cells of a non-transgenic scion of a plant grafted onto a transgenic stock comprising the chimeric genes of the invention (or vice versa) a method which may be important in horticulture, viticulture or in fruit production.

A resistance to plant pathogens such as arachnids, fungi, insects, nematodes, protozoans, viruses, bacteria and diseases can be achieved by reducing the gene expression of genes which are essential for the growth, survival, certain developmental stages (for example pupation) or the multiplication of a certain pathogen. A suitable reduction can bring about a complete inhibition of the above steps, but also a delay of one or more steps, This may be plant genes which, for example, allow the pathogen to enter, but may also be pathogen-homologous genes. Preferably, the chimeric RNA (or the dsRNA derived therefrom) is directed against genes of the pathogen. For example, plants can be treated with suitable formulations of abovementioned agents, for example sprayed or dusted, the plants themselves, however, may also comprise the agents in the form of a transgenic organism and pass them on to the pathogens, for example in the form of a stomach poison. Various essential genes of a variety of pathogens are known to the skilled worker (for example for nematode resistance: WO 93/10251, WO 94/17194).

Thus, an aspect of this invention provides a method where the target gene for suppression encodes a protein in a plant pathogen (e.g., an insect or nematode). In an aspect, a method comprises introducing into the genome of a pathogen-targeted plant a nucleic acid construct comprising DNA which is transcribed into a chimeric RNA that forms at least one dsRNA molecule which is effective for reducing expression of a target gene within the pathogen when the pathogen (e.g., insect or nematode) ingests or infects cells from said plant. In a preferred embodiment, the gene suppression is fatal to the pathogen. Most preferred as pathogen are fungal pathogens such as *Phytophthora infestans, Fusarium nivale, Fusarium graminearum, Fusarium culmorum, Fusarium oxysporum, Blumeria graminis, Magnaporthe grisea, Sclerotinia sclerotium, Septoria nodorum, Septoria tritici, Alternaria brassicae, Phoma lingam*, bacterial pathogens such as *Corynebacterium sepedonicum, Erwinia carotovora, Erwinia amylovora, Streptomyces scabies, Pseudomonas syringae* pv. *tabaci, Pseudomonas syringae* pv. *phaseolicola, Pseudomonas syringae* pv. *tomato, Xanthomonas campestris* pv. *malvacearum* and *Xanthomonas campestris* pv. *oryzae*, and nematodes such as *Globodera rostochiensis, G. pallida, Heterodera schachtii, Heterodera avenae, Ditylenchus dipsaci, Anguina tritici* and *Meloidogyne hapla.*

Resistance to viruses can be obtained for example by reducing the expression of a viral coat protein, a viral replicase, a viral protease and the like. A large number of plant viruses and suitable target genes are known to the skilled worker. The methods and compositions of the present invention are especially useful to obtain nematode resistant plants (for target genes see e.g., WO 92/21757, WO 93/10251, WO 94/17194).

Also provided by the invention is a method for obtaining pathogen resistant organisms, particularly plants, comprising the steps of providing cells of the organism with an chimeric RNA molecule of the invention, said chimeric RNA molecule capable to provide in an eukaryotic cell an at least partially double-stranded RNA molecule, said chimeric RNA molecule comprising a) at least one first ribonucleotide sequence that is substantially identical to at least a part of a target nucleotide sequence of at least one gene of a pathogen, and
b) at least one second ribonucleotide sequence which is substantially complementary to said first nucleotide sequence and is capable to hybridizes to said first nucleotide sequence to form a double-stranded RNA structure, and
c) at least one third ribonucleotide sequence located between said first and said second ribonucleotide sequence comprising at least one removable RNA element, which can be removed by the RNA processing mechanism of an eukaryotic cell without subsequently covalently joining the resulting sequences comprising said first and said second ribonucleotide sequence, respectively.

Preferably, said first ribonucleotide sequence has between 65 and 100% sequence identity, preferably, between 75 and 100%, more preferably between 85 and 100%, most preferably between 95 and 100%, with at least part of the nucleotide sequence of the genome of a pathogen. More preferably the pathogen is selected from the group of virus, bacteria, fungi, and nematodes.

3.1.2.7. Prevention of Stem Break

A reduced susceptibility to stem break can be obtained for example by reducing the gene expression of genes of the carbohydrate metabolism (see above). Advantageous genes are described (WO 97/13865, inter alia) and comprise tissue-specific polygalacturonases or cellulases.

For this application either a miRNA-tag, which allows for enhanced specific expression in stem is preferred for designing the miRNA-tag. For example, maize miR159 is expressed predominantly in stem, use of miR159 binding site (complementary to Zm miR159) in a ta-siRNA primary transcript can enhance specific expression of gene-of-interest in stem.

3.1.2.8. Delay of Fruit Maturation

Delayed fruit maturation can be achieved for example by reducing the gene expression of genes selected from the group consisting of polygalacturonases, pectin esterases, 洄-(1-4)glucanases (cellulases), 洄-galactanases 洄-galactosidases), or genes of ethylene biosynthesis, such as 1-aminocyclopropane-1-carboxylate synthase, genes of carotenoid biosynthesis such as, for example, genes of prephytoene or phytoene biosynthesis, for example phytoene desaturases. Further advantageous genes are, for example, in WO 91/16440, WO 91/05865, WO 91/16426, WO 92/17596, WO 93/07275 or WO 92/04456, U.S. Pat. No. 5,545,366).

For this application either a miRNA-tag, which allows for enhanced specific expression in fruits is preferred for designing the miRNA-tag.

3.1.2.9. Achieving male sterility. Suitable target genes are described in WO 94/29465, WO89/10396, WO 92/18625, inter alia. A particular application for reduction of the phenotypic expression of a transgene in a plant cell, inter alia, has been described for the restoration of male fertility, the latter being obtained by introduction of a transgene comprising a male sterility DNA (WO 94/09143, WO 91/02069). The nucleic acid of interest is specifically the male sterility DNA.

For this application either a miRNA-tag, which allows for enhanced specific expression in pollen is preferred for designing the miRNA-tag.

3.1.2.10. Reduction of undesired or toxic plant constituents such as, for example, glucosinolates. Suitable target genes are described (in WO 97/16559, inter alia). For this application either a miRNA-tag, which allows for enhanced specific expression in seeds is preferred for designing the miRNA-tag. For example, maize miR167 is expressed predominantly in seeds, use of miR167 binding site (complementary to Zm miR167) in ta-siRNA primary transcript could enhance seed-specific silencing.

3.1.2.11. Delay of senescence symptoms. Suitable target genes are, inter alia, cinnamoyl-CoA:NADPH reductases or cinnamoyl alcohol dehydrogenases. Further target genes are described (in WO 95/07993, inter alia).

3.1.2.12. Modification of the lignification and/or the lignin content, mainly in tree species. Suitable target genes are described in WO 93/05159, WO 93/05160, inter alia.

3.1.2.13. Modification of the fiber content in foodstuffs, preferably in seeds, by reducing the expression of coffeic acid O-methyltransferase or of cinnamoyl alcohol dehydrogenase.

3.1.2.14. Modification of the fiber quality in cotton. Suitable target genes are described in U.S. Pat. No. 5,597,718, inter alia.

3.1.2.15. Reduction of the susceptibility to bruising of, for example, potatoes by reducing for example polyphenol oxidase (WO 94/03607) and the like.

3.1.2.16. Enhancement of vitamin E biosynthesis, for example by reducing the expression of genes from the homogentisate catabolic pathway such as, for example, homogentisate 1,2-dioxygenase (HGD; EC No.: 1.13.11.5), maleyl-acetoacetate isomerase (MAAI; EC No.: 5.2.1.2.) or fumaryl-acetoacetate hydrolase (FAAH; EC No.: 3.7.1.2).

3.1.2.17. Reduction of the nicotine content for example in tobacco by reduced expression of, for example, N-methylputrescin oxidase and putrescin N-methyltransferase.

3.1.2.18. Reduction of the caffeine content in coffee bean (e.g., *Coffea arabica*) by reducing the gene expression of genes of caffeine biosynthesis such as 7-methylxanthine 3-methyltransferase.

3.1.2.19. Reduction of the theophylline content in tea (*Camellia sinensis*) by reducing the gene expression of genes of theophylline biosynthesis such as, for example, 1-methylxanthine 3-methyltransferase.

3.1.2.20. Increase of the methionine content by reducing threonine biosynthesis, for example by reducing the expression of threonine synthase (Zeh M et al. (2001)

Plant Physiol 127(3):792-802).

Furthermore the method and compounds of the invention can be used for obtaining shatter resistance (WO 97/13865), for obtaining modified flower color patterns (EP 522 880, U.S. Pat. No. 5,231,020), for reducing the presence of unwanted (secondary) metabolites in organisms, such as glucosinolates (WO97/16559) or chlorophyll content (EP 779 364) in plants, for modifying the profile of metabolites synthesized in a eukaryotic cell or organisms by metabolic engineering e.g. by reducing the expression of particular genes involved in carbohydrate metabolism (WO 92/11375, WO 92/11376, U.S. Pat. No. 5,365,016, WO 95/07355) or lipid biosynthesis (WO 94/18337, U.S. Pat. No. 5,530,192) etc. Further examples of advantageous genes are mentioned for example in Dunwell J M, Transgenic approaches to crop improvement, J Exp Bot. 2000; 51 Spec No; pages 487-96.

Each of the abovementioned applications can be used as such on its own. Naturally, it is also possible to use more than one of the abovementioned approaches simultaneously. If, in this context, all approaches are used, the expression of at least two differing target genes as defined above is reduced. In this context, these target genes can originate from a single group of genes which is preferred for a use, or else be assigned to different use groups.

3. Exemplification

Those skilled in the art will recognize, or be able to ascertain using no more than routine experimentation, many equivalents to the specific embodiments of the invention described herein. Such equivalents are intended to be encompassed by the following claims. The entire contents of all patents, published patent applications and other references cited herein are hereby expressly incorporated herein in their entireties by reference.

The invention, now being generally described, will be more readily understood by reference to the following examples, which are included merely for purposes of illustration of certain aspects and embodiments of the present invention and are not intended to limit the invention.

SEQUENCES

1. SEQ ID NO 1: ribonucleotide sequence encoding maize ta-siRNA primary transcript
2. SEQ ID NO 2: ribonucleotide sequence encoding wheat ta-siRNA primary transcript
3. SEQ ID NO 3: ribonucleotide sequence encoding rice ta-siRA primary transcript
4. SEQ ID NO 4: ribonucleotide sequence encoding cotton ta-siRNA primary transcript
5. SEQ ID NO 5: ribonucleotide sequence encoding soybean ta-siRNA primary transcript
6. SEQ ID NO 6: ribonucleotide sequence encoding canola ta-siRNA primary transcript
7. SEQ ID NO 7: ribonucleotide sequence encoding sunflower ta-siRNA primary transcript
8. SEQ ID NO 8: ribonucleotide sequence encoding barley ta-siRNA primary transcript
9. SEQ ID NO 9: ribonucleotide sequence encoding tomato ta-siRNA primary transcript
10. SEQ ID NO 10: ribonucleotide sequence encoding sorghum ta-siRNA primary transcript
11. SEQ ID NO 11: ribonucleotide sequence encoding spruce ta-siRNA primary transcript
12. SEQ ID NO 12: ribonucleotide sequence encoding cocoa ta-siRNA primary transcript
13. SEQ ID NO 13: ribonucleotide sequence encoding grape ta-siRNA primary transcript
14. SEQ ID NO 14: ribonucleotide sequence encoding lotus ta-siRNA primary transcript
15. SEQ ID NO 15: ribonucleotide sequence encoding poplar ta-siRNA primary transcript
16. SEQ ID NO 16: ribonucleotide sequence encoding *Arabidopsis* TAS1a
17. SEQ ID NO 17: ribonucleotide sequence encoding *Arabidopsis* TAS1b
18. SEQ ID NO 18: ribonucleotide sequence encoding *Arabidopsis* TAS1c
19. SEQ ID NO 19: ribonucleotide sequence encoding *Arabidopsis* TAS2
20. SEQ ID NO 20: ribonucleotide sequence encoding *Arabidopsis* TAS3
21. SEQ ID NO 21: MW-P1F, oligonucleotide primer 5'-aggtcaaata aggaaaacga-3'
22. SEQ ID NO 22: MW-P2R, oligonucleotide primer 5'-gccttgcaaa ataagaatac ca-3'
23. SEQ ID NO 23: pRMW1, a Gateway entry vector containing ta-siRNA At2g27400 primary transcrip
24. SEQ ID NO 24: pRMW5, a Gateway entry vector containing engineered ta-siRNA targeting GUS reporter gene
25. SEQ ID NO 25: pRMW6, a Gateway entry vector containing engineered ta-siRNA targeting GUS reporter gene
26. SEQ ID NO 26: pRMW7, a Gateway entry vector containing engineered ta-siRNA targeting GUS reporter gene
27. SEQ ID NO 27: pRMW8, a Gateway entry vector containing engineered ta-siRNA targeting non-specific nucleotide acid as a control
28. SEQ ID NO 28: MW-P17F, oligonucleotide primer 5'-agcttgacta gagaattcga atcc-3'
29. SEQ ID NO 29: MW-P18R, oligonucleotide primer 5'-gatccgggct gcacatacat aac-3'

30. SEQ ID NO 30: pRMW9, a Gateway entry vector containing PcUbi-4-2 promoter
31. SEQ ID NO 31: pRMW13, a binary vector for expressing engineered ta-siRNA gene targeting GUS reporter gene.
32. SEQ ID NO 32: pRMW14, a binary vector for expressing engineered ta-siRNA gene targeting GUS reporter gene.
33. SEQ ID NO 33: pRMW15, a binary vector for expressing engineered ta-siRNA gene targeting GUS reporter gene.
34. SEQ ID NO 34: pRMW16, a binary vector for expressing engineered ta-siRNA gene targeting non-specific nucleotide acid as a control.
35. SEQ ID NO 35: pRLM293, a Gateway entry vector containing NOS terminator
36. SEQ ID NO 36: pRLM251, a Gateway destination vector
37. SEQ ID NO 37: MW-P11F, oligonucleotide primer 5'-ccatatcgca acgatgacgt-3'
38. SEQ ID NO 38: MW-P12R, oligonucleotide primer 5'-gccagtcccc ttgatagcga-3'
39. SEQ ID NO 39: pRMW2, a Gateway entry vector containing *Arabidopsis* ta-siRNA At3g17185 primary transcript.
40. SEQ ID NO 40: pRMW23, a Gateway entry vector containing engineered ta-siRNA targeting *Arabidopsis* phytoene desaturase gene.
41. SEQ ID NO 41: pRMW24, a Gateway entry vector containing engineered ta-siRNA targeting *Arabidopsis* phytoene desaturase gene.
42. SEQ ID NO 42: pRMW25 (=pRSM5), a Gateway entry vector containing engineered ta-siRNA targeting *Arabidopsis* phytoene desaturase gene.
43. SEQ ID NO 43: pRMW26 (=pRSM6), a Gateway entry vector containing engineered ta-siRNA targeting *Arabidopsis* phytoene desaturase gene.
44. SEQ ID NO 44: pRPR57, a Gateway entry vector containing maize ta-siRNA primary transcript
45. SEQ ID NO 45: nucleic acid sequence encoding complementary sequence of the target region of DsRed 2-2
46. SEQ ID NO 46: pRPR58, a Gateway entry vector containing engineered ta-siRNAs targeting DsRed2. pRPR58 is identical to pRPR57 except 5'D7(+) and 5'D8(+) phases replaced
47. SEQ ID NO 47: nucleic acid sequence encoding complementary sequence of the target region of DsRed 2-1
48. SEQ ID NO 48: pRPR59, a Gateway entry vector containing engineered ta-siRNAs targeting DsRed2. pRPR59 is identical to pRPR57 except 5'D7(+) and 5'D8(+) phases replaced.
49. SEQ ID NO 49: pRLM283, a Gateway entry vector containing sugarcane bacilliform virus (ScBV) promoter.
50. SEQ ID NO 50: pRLM336, a Gateway entry vector containing maize Glb1 promoter.
51. SEQ ID NO 51: pRPR56, a Gateway entry vector containing rice chloroplast protein 12-like (Os.CP12) promoter plus the first intron from metallothionin gene.
52. SEQ ID NO 52: pRLM217, a Gateway destination vector that contains the following components and flanked by recombination sites attL4 and attR1. Maize ubiquitin plus intron promoter, *E. coli* D-serine dehydratase [dsdA] as a selection marker and octopine synthase 3 terminator.
53. SEQ ID NO 53: pRLM373, a binary vector constructed via multi-site Gateway cloning with following configuration: T-DNA left boder, Ubi promoter, Ocs terminater, attB4 site, ScBV promoter, attB1 site, maize ta-siRNA precursor, attB2 site, Nos terminator, T-DNA right border
54. SEQ ID NO 54: pRLM376, a binary vector identical to pRLM373 except 5'D7 (+) and 5'D8 (+) phases are replaced with DNA fragments targeting DsRed 2 gene
55. SEQ ID NO 55: pRLM379, a binary vector identical to pRLM373 except 5'D7 (+) and 5'D8 (+) phases are replaced with DNA fragments targeting DsRed 2 gene.
56. SEQ ID NO 56: pRLM374, a binary vector identical to pRLM373 except globulin 1 promoter is used to replace ScBV promoter
57. SEQ ID NO 57: pRLM377, a binary vector identical to pRLM374 except 5' D7 (+) and 5' D8 (+) phases are replaced by DNA fragments targeting DsRed 2 gene
58. SEQ ID NO 58: pRLM380, a binary vector identical to pRLM377 except 5' D7 (+) and 5' D8 (+) phases are replaced by DNA fragments targeting DsRed 2 gene
59. SEQ ID NO 59: pRLM375, a binary vector and the expression of pre-ta-siRNA is under control of Os.CP12 promoter with rice metallothionin (Os.MET) intron1 and NOS terminator. 5'D7(+) and 5'D8(+) ta-siRNAs target endogenous gene encoding ARF4.
60. SEQ ID NO 60: pRLM378, a binary vector and the expression of pre-ta-siRNA is under control of Os.CP12 promoter and NOS terminator. The engineered 5'D7(+) and 5'D8(+) ta-siRNAs target DsRed2 reporter gene (position 341-362 bp) in leaf.
61. SEQ ID NO 61: pRLM381, a binary vector and the expression of pre-ta-siRNA is under control of Os.CP12 promoter and NOS terminator. The engineered 5'D7(+) and 5'D8(+) ta-siRNAs target DsRed2 reporter gene (position 26-44 bp and 341-362 bp, respectively) in leaf.
62. SEQ ID NO 62: pRPR29, nucleic acid sequence containing engineered 5' D7 and D8 phases targeting maize phytoene desaturase gene.
63. SEQ ID NO 63: nucleic acid sequence encoding engineered 5' D8 (+) phase targeting maize phytoene desaturase gene.
64. SEQ ID NO 64: nucleic acid sequence encoding engineered 5' D7 (+) phase targeting maize phytoene desaturase gene.
65. SEQ ID NO 65: pRPR22, a Gateway entry vector containing engineered ta-siRNA targeting maize phytoene desaturase gene.
66. SEQ ID NO 66: pRPR31 (=pRLM424), a binary vector identical to pRLM373 except 5'D7 (+) and 5' D8 (+) phases are replaced by a DNA fragment targeting maize phytoene desaturase gene.
67. SEQ ID NO 67: pRPR32 (pRLM428), a binary vector identical to pRLM375 except 5' D7 (+) and 5' D8 (+) phases are replaced by a DNA fragment targeting maize phytoene desaturase gene.
68. SEQ ID NO 68: pRPR35, nucleic acid sequence containing engineered 5' D7 (+) and 5'D8 (+) phases plus engineered miR166 binding site.
69. SEQ ID NO 69: nucleic acid sequence encoding miR166 binding site
70. SEQ ID NO 70: ribonucleic acid sequence encoding Zm miR166
71. SEQ ID NO 71: pRPR36, a Gateway entry vector identical to pRP58 except miR390 binding site is replaced by miR166 binding site.
72. SEQ ID NO 72: pRPR37, nucleotide sequence containing engineered 5' D7 (+) and 5'D8 (+) phases plus engineered miR166 binding site
73. SEQ ID NO 73: nucleic acid sequence encoding miR167 binding site 74. SEQ ID NO 74: ribonucleic acid sequence encoding Zm miR167
75. SEQ ID NO 75: pRPR38, a Gateway entry vector identical to pRPR36 except miR166 binding site replaced by niR167 binding site.
76. SEQ ID NO 76: pRPR39, a binary vector identical to pRLM376 except miR390 binding site is replaced by miR166 binding site
77. SEQ ID NO 77: pRPR40 (pRPR47, a binary vector identical to pRLM376 except miR390 binding site replaced by miR167 binding site
78. SEQ ID NO 78: ribonucleic acid sequence encoding *Arabidopsis* small RNA 18
79. SEQ ID NO 79: ribonucleic acid sequence encoding *Arabidopsis* small RNA 19
80. SEQ ID NO 80: ribonucleic acid sequence encoding *Arabidopsis* small RNA 14
81. SEQ ID NO 81: nucleic acid sequence encoding *Arabidopsis* small RNA 18 binding site
82. SEQ ID NO 82: nucleic acid sequence encoding *Arabidopsis* small RNA 19 binding site
83. SEQ ID NO 83: nucleic acid sequence encoding *Arabidopsis* small RNA 14 binding site
84. SEQ ID NO 84: ribonucleic acid sequence encoding *Arabidopsis* miRNA (at-miR160b)
85. SEQ ID NO 85: ribonucleic acid sequence encoding *Arabidopsis* miRNA (at-miR163)
86. SEQ ID NO 86: ribonucleic acid sequence encoding *Arabidopsis* miRNA (at-miR167a)
87. SEQ ID NO 87: ribonucleic acid sequence encoding *Arabidopsis* miRNA (at-miR172b)
88. SEQ ID NO 88: ribonucleic acid sequence encoding *Arabidopsis* miRNA (at-miR319b)
89. SEQ ID NO 89: ribonucleic acid sequence encoding rice miRNA (os-miR156a)
90. SEQ ID NO 90: ribonucleic acid sequence encoding rice miRNA (os-miR156l)
91. SEQ ID NO 91: ribonucleic acid sequence encoding rice miRNA (os-miR159b)
92. SEQ ID NO 92: ribonucleic acid sequence encoding rice miRNA (os-miR160f)
93. SEQ ID NO 93: ribonucleic acid sequence encoding rice miRNA (os-miR162a)
94. SEQ ID NO 94: ribonucleic acid sequence encoding rice miRNA (os-miR164a)
95. SEQ ID NO 95: ribonucleic acid sequence encoding rice miRNA (os-miR164d)
96. SEQ ID NO 96: ribonucleic acid sequence encoding rice miRNA (os-miR166a)
97. SEQ ID NO 97: ribonucleic acid sequence encoding rice miRNA (os-miR167g)
98. SEQ ID NO 98: ribonucleic acid sequence encoding rice miRNA (os-miR168a)
99. SEQ ID NO 99: ribonucleic acid sequence encoding rice miRNA (os-miR169g)
100. SEQ ID NO 100: ribonucleic acid sequence encoding rice miRNA (os-miR169i)
101. SEQ ID NO 101: ribonucleic acid sequence encoding rice miRNA (os-miR171b)
102. SEQ ID NO 102: ribonucleic acid sequence encoding rice miRNA (os-miR397b)
103. SEQ ID NO 103: ribonucleic acid sequence encoding rice miRNA (os-miR398a)
104. SEQ ID NO 104: ribonucleic acid sequence encoding rice miRNA (os-miR399k)
105. SEQ ID NO 105: ribonucleic acid sequence encoding maize miRNA (zm-miR156)
106. SEQ ID NO 106: ribonucleic acid sequence encoding maize miRNA (zm-miR159)
107. SEQ ID NO 107: ribonucleic acid sequence encoding maize miRNA (zm-miR160b)
108. SEQ ID NO 108: ribonucleic acid sequence encoding maize miRNA (zm-miR166)
109. SEQ ID NO 109: ribonucleic acid sequence encoding maize miRNA (zm-miR167)
110. SEQ ID NO 110: ribonucleic acid sequence encoding maize miRNA (zm-miR171)

Further Sequences are listed in the Seq. Protocol enclosed to this application.

EXAMPLES

General Methods

Unless otherwise specified, all chemicals are obtained from Fluka (Buchs), Merck (Darmstadt), Roth (Karlsruhe), Serva (Heidelberg) and Sigma (Deisenhofen). Restriction enzymes, DNA-modifying enzymes and molecular biology kits were from Amersham-Pharmacia (Freiburg), Biometra (Gottingen), Roche (Mannheim), New England Biolabs (Schwalbach), Novagen (Madison, Wis., USA), Perkin-Elmer (Weiterstadt), Qiagen (Hilden), Stratagen (Amsterdam, Netherlands), Invitrogen (Karlsruhe) and Ambion (Cambridgeshire, United Kingdom). The reagents used were employed in accordance with the manufacturer's instructions.

The practice of the present invention will employ, unless otherwise indicated, conventional techniques of cell biology, cell culture, molecular biology, microbiology, recombinant DNA, and immunology, which are within the skill of the art. Such techniques are explained fully in the literature. See, for example, Molecular Cloning A Laboratory Manual, 2nd Ed., ed. by Sambrook, J. et al. (Cold Spring Harbor Laboratory Press (1989)); Short Protocols in Molecular Biology, 3rd Ed., ed. by Ausubel, F. et al. (Wiley, N.Y. (1995)); DNA Cloning, Volumes I and II (D. N. Glover ed., 1985); Oligonucleotide Synthesis (M. J. Gait ed. (1984)); Mullis et al. U.S. Pat. No. 4,683,195; Nucleic Acid Hybridization (B. D. Hames & S. J. Higgins eds. (1984)); the treatise, Methods In Enzymology (Academic Press, Inc., N.Y.); Immunochemical Methods In Cell And Molecular Biology (Mayer and Walker, eds., Academic Press, London (1987)); Handbook Of Experimental Immunology, Volumes I-IV (D. M. Weir and C. C. Blackwell, eds. (1986)); and Miller, J. Experiments in Molecular Genetics (Cold Spring Harbor Press, Cold Spring Harbor, N.Y. (1972)).

The chemical synthesis of oligonucleotides can be carried out for example in the known manner using the phosphoamidite method (Voet, Voet, 2nd edition, Wiley Press New York, pages 896-897). The cloning steps carried out for the purpose of the present invention such as, for example, restriction cleavages, agarose gel electrophoresis, purification of DNA fragments, transfer of nucleic acids to nitrocellulose and nylon membranes, linking DNA fragments, transformation of *E. coli* cells, bacterial cultures, propagation of phages and sequence analysis of recombinant DNA, are carried out as described in Sambrook et al. (1989) Cold Spring Harbor Laboratory Press; ISBN 0-87969-309-6. Recombinant DNA molecules are sequenced using an ABI laser fluorescence DNA sequencer by the method of Sanger (Sanger et al. (1977) Proc Natl Acad Sci USA 74:5463-5467).

Example 1: *Agrobacterium*-Mediated Transformation in Dicotyledonous and Monocotyledonous Plants 1.1 Transformation and Regeneration of Transgenic *Arabidopsis thaliana* (Columbia) Plants To generate transgenic *Arabidopsis plants, Agrobacterium tumefaciens* (strain C58C1 pGV2260) is transformed with various constructs. The agrobacterial strains are subsequently used to generate transgenic plants. To this end, a single transformed *Agrobacterium* colony is incubated overnight at 28° C. in a 4 mL culture (medium: YEB medium with 50 洞 g/mL kanamycin and 25 洞 g/mL rifampicin). This culture is subsequently used to inoculate a 400 mL culture in the same medium, and this is incubated overnight (28° C., 220 rpm) and spun down (GSA rotor, 8,000 rpm, 20 min). The pellet is resuspended in infiltration medium (1/2 MS medium; 0.5 g/L MES, pH 5.8; 50 g/L sucrose). The suspension is introduced into a plant box (Duchefa), and 100 μL of SILWET L-77 (heptamethyltrisiloxan modified with polyalkylene oxide; Osi Specialties Inc., Cat. P030196) was added to a final concentration of 0.02%. In a desiccator, the plant box with 8 to 12 plants is exposed to a vacuum for 10 to 15 minutes, followed by spontaneous aeration. This is repeated twice or 3 times. Thereupon, all plants are planted into flowerpots with moist soil and grown under long-day conditions (daytime temperature 22 to 24° C., nighttime temperature 19° C.; relative atmospheric humidity 65%). The seeds are harvested after 6 weeks.

As an alternative, transgenic *Arabidopsis* plants can be obtained by root transformation. White root shoots of plants with a maximum age of 8 weeks are used. To this end, plants, which are kept under sterile conditions in 1 MS medium (1% sucrose; 100 mg/L inositol; 1.0 mg/L thiamine; 0.5 mg/L pyridoxine; 0.5 mg/L nicotinic acid; 0.5 g MES, pH 5.7; 0.8% agar) are used. Roots are grown on callus-inducing medium for 3 days (1× Gamborg's B5 medium; 2% glucose; 0.5 g/L mercaptoethanol; 0.8% agar; 0.5 mg/L 2,4-D (2,4-dichlorophenoxyacetic acid); 0.05 mg/L kinetin). Root sections 0.5 cm in length are transferred into 10 to 20 mL of liquid callus-inducing medium (composition as described above, but without agar supplementation), inoculated with 1 mL of the above-described overnight agrobacterial culture (grown at 28° C., 200 rpm in LB) and shaken for 2 minutes. After excess medium has been allowed to run off, the root explants are transferred to callus-inducing medium with agar, subsequently to callus-inducing liquid medium without agar (with 500 mg/L betabactyl, SmithKline Beecham Pharma GmbH, Munich), incubated with shaking and finally transferred to shoot-inducing medium (5 mg/L 2-isopentenyladenine phosphate; 0.15 mg/L indole-3-acetic acid; 50 mg/L kanamycin; 500 mg/L betabactyl). After 5 weeks, and after 1 or 2 medium changes, the small green shoots are transferred to germination medium (1 MS medium; 1% sucrose; 100 mg/L inositol; 1.0 mg/L thiamine; 0.5 mg/L pyridoxine; 0.5 mg/L nicotinic acid; 0.5 g MES, pH 5.7; 0.8% agar) and regenerated into plants.

1.2 Transformation and Regeneration of Crop Plants

The *Agrobacterium*-mediated plant transformation using standard transformation and regeneration techniques may also be carried out for the purposes of transforming crop plants (Gelvin & Schilperoort (1995) Plant Molecular Biology Manual, 2nd Edition, Dordrecht: Kluwer, Academic Publ. ISBN 0-7923-2731-4; Glick & Thompson (1993) Methods in Plant Molecular Biology and Biotechnology, Boca Raton: CRC Press, ISBN 0-8493-5164-2)

For example, oilseed rape can be transformed by cotyledon or hypocotyl transformation (Moloney et al. (1989) Plant Cell Reports 8: 238-242, de Block et al. (1989) Plant Physiol. 91:694-701) The use of antibiotics for the selection of *Agrobacteria* and plants depends on the binary vector and the *Agrobacterium* strain used for the transformation. The selection of oilseed rape is generally carried out using kanamycin as selectable plant marker. The *Agrobacterium*-mediated gene transfer in linseed (*Linum usitatissimum*) can be carried out using for example a technique described by Mlynarova et al. ((1994) Plant Cell Report 13: 282-285). The transformation of soya can be carried out using, for example, a technique described in EP-A1 0424 047 or in EP-A1 0397 687, U.S. Pat. No. 5,376,543, U.S. Pat. No. 5,169,770. The transformation of maize or other monocotyledonous plants can be carried out using, for example, a technique described in U.S. Pat. No. 5,591,616.

The transformation of plants using particle bombardment, polyethylene glycol-mediated DNA uptake or via the silicon carbonate fiber technique is described, for example, by Freeling & Walbot (1993) "The maize handbook" ISBN 3-540-97826-7, Springer Verlag New York).

Example 2 Identify Plant ta-siRNA Primary Transcripts Through Datamining

Allen et al., (2005) described five *Arabidopsis* ta-siRNA primary transcripts, four of which are initiated by miRl73 and the fifth by miR390. The loci encode miRl73-directed ta-siRNA are three paralogous loci TASla (At2g27400), TAS1b (Atl g50055) and TAS1c (At2g39675), plus TAS2, antisense to the annotated sequence at At2g39680. The locus encodes miR390-directed ta-siRNA is At3g17185. The authors also described 5'D7(+) and 5'D8(+) phase sequences as well as miR390 binding site from several plant species (Cell 121:207-221, 2005). Based on these short conserved sequences, blastn search was conducted using public databases (e.g. tigrblast.tigr.org/tgi/) and an in-house database to identify the primary transcripts from many dicot and monocot species. For example, in a BLAST search using conserved 5'D7(+) and 5'D8(+) ta-siRNAs, a serial overlapping ESTs (AY109233, BE519095, BM268436, BM349498, BM351282, BZ323111, CF012706, and CG201712) and a genomic sequence were identified in a maize database (maizegdb.org). After alignment analysis of these EST and genomic sequences, a maize ta-siRNA primary transcript was identified.

The phase formation of ta-siRNAs are initiated by miRNAs. In the case of miR173-guided ta-siRNA, miR173 binds to its complementary site in the primary transcript and subsequently cleaves the transcript between position 10 and 11 from 5' end of miR173. From this cleavage site, a series of about 21 nt phases of ta-siRNA are generated via 5' to 3' direction involving a group of key enzymes such as RDR6, SGS3 and Dicer. A similar process applies to generate miR390-guided ta-siRNAs, except the formation of ta-siRNA is via 3' to 5' direction starting from miR390 cleavage site.

All ta-siRNA primary transcripts, either initiated by miR173 or by miR390, can be used for engineering so that at least one of 21-nt phase ta-siRNA targets a gene-of-interest and down-regulates its expression. An engineered ta-siRNA primary transcript based on one species (e.g. maize) could be functional in another species (e.g. soybean) provided that the transcripts initiated by appropriate miRNA (e.g. miR390 presence in both maize and soybean). Below is a list of ta-siRNA primary transcripts identified through datamining: Maize (SEQ ID NO:1), Wheat (SEQ ID NO: 2), Rice (SEQ ID NO: 3), Cotton (SEQ ID NO: 4), Soybean (SEQ ID NO: 5), Canola (SEQ ID NO: 6), Sunflower (SEQ ID NO: 7), Barley (SEQ ID NO: 8), Tomato (SEQ ID NO: 9), *Sorghum* (SEQ ID NO: 10), Spruce (SEQ ID NO: 11), Cocoa (SEQ ID NO: 12), Grape (SEQ ID NO: 13), *Lotus*

(SEQ ID NO: 14) and *Populus* (SEQ ID NO: 15), *Arabidopsis* TAS1a (SEQ ID NO: 16), *Arabidopsis* TAS1b (SEQ ID NO: 17), *Arabidopsis* TAS1c (SEQ ID NO: 18), *Arabidopsis* TAS2 (SEQ ID NO: 19) and *Arabidopsis* TAS3 (SEQ ID NO: 20)

Although ta-siRNAs were first discovered by a small RNA cloning approach coupled with genetic analysis (Vazquez et al., (2004) Molecular Cell 16: 69-79; Allen et al., (2005) Cell 121: 207-221), more recently a protocol to mine an *Arabidopsis* nonannotated, noncoding EST database was successfully developed to identify ta-siRNA primary transcripts. Such protocol is largely based upon the conservation of certain ta-siRNAs and their targets among different plant species (Williams et al., (2005), PNAS, 9703-9708).

Example 3. Engineering *Arabidopsis* miR173 Regulated ta-siRNA At2g27400 (TAS1a) for Down-Regulating Gus Gene Expression in Transgenic *Arabidopsis* Plants

*Arabidopsis* GUS transgenic plants contain an ubiquitin promoter from parsley (Petroselinum crispum Pc.ubiquitin; 996 bp), a full-length 洞-glucuronidase gene (GUS reporter gene; 2,001 bp), and a nopaline synthase (NOS) terminator (253 bp) from *Agrobacterium* tumefacenes. In transgenic *Arabidopsis*, GUS gene expression is detected constitutively and ubiquitously in the whole plant due to the ubiquitin promoter activity.

At2g27400 gene was PCR amplified from *Arabidopsis* genomic DNA using primer MW-P1F (AGGTCAAATAAGGAAAACGA) (SEQ ID NO: 21) and MW-P2R (GCCTTGCAAAATAAGAATACCA) (SEQ ID NO: 22) and TA cloned into Gateway entry vector PCR8/GW/TOPO (Invitrogen #K2500-20). This construct was named pRMW1 (SEQ ID NO: 23). In pRMW1, the 799 bp At2g27400 gene contains 180 bp ta-siRNA region, a 423 bp ta-siRNA upstream region (potential promoter region) and a 196 bp downstream region (potential terminator region). Among the eight 21-nt ta-siRNA phases starting from the 11th position in miR173, the 3'D2(+), 3'D4(+) and 3'D6(+) phases were replaced with three 21-nt GUS sequences. Thymine was used at the beginning of the three GUS-ta-siRNA sequences. Mismatches to GUS sequence at position 18 and 21 were introduced to mimic the base pairing mismatches between the native ta-siRNA and their target genes in *Arabidopsis* plant (Table 3).

TABLE 3

Gateway entry vectors for engineered ta-siRNA targeting to GUS gene.

| Construct Name | Engineered 3'D2(+) Sequence | Engineered 3'D4(+) Sequence | Engineered 3'D6(+) Sequence |
|---|---|---|---|
| PRMW5 (SEQ ID NO: 24) | taatcgcctgtaagtgcactc (Target GUS M1346) | taatcgcctgtaagtgcactc (Target GUS M1346) | taatcgcctgtaagtgcactc (Target GUS M1346) |
| pRMW6 (SEQ ID NO: 25) | ttaccatccgtaataacagtc (Target GUS C1585) | ttaccatccgtaataacagtc (Target GUS C1585) | ttaccatccgtaataacagtc (Target GUS C1585) |
| pRMW7 (SEQ ID NO: 26) | Tacctttcggtataaagcctc (target GUS N215) | Taatcgcctgtaagtgcactc (target GUS M1346) | ttaccatccgtaataacagtc (Target GUS C1585) |
| pRMW8 (SEQ ID NO: 27) | ctcacgtgaatgtccgctaat (Random sequence scrambled from GUS M1346 targeted TA-siRNA sequence) | Ctcacgtgaatgtccgctaat (Random sequence scrambled from GUS M1346 targeted TA-siRNA sequence) | ctcacgtgaatgtccgctaat (Random sequence scrambled from GUS M1346 targeted TA-siRNA sequence) |
| PRMW1 (SEQ ID NO: 23) | tcctaagtccaacatagcgtt (wild-type TAS1a 3'D2(+) phase sequence) | ttttaagtctaacatagcgtt (wild-type TAS1a 3'D4(+) phase sequence) | ttctaagtccaacatagcgta (wild-type TAS1a 3'D6(+) phase sequence) |

Note:
GUS M1346 means the position 1346 in the middle of GUS.
GUS C1585 means the position 1586 in the C-terminus of GUS.
GUS N1585 means the position 215 in the N-terminus of GUS.

These four constructs containing GUS-ta-siRNAs were used as gene of interest Gateway entry vectors in generating binary vectors for plant transformation.

To express PDS-ta-siRNA in *Arabidopsis*, three promoters were chosen: parsley ubiquitin promoter (Pc.ubi), *Arabidopsis* leaf-preferable promoter (UK398, EP 01666599 and US 20060156429), and faba bean unknown seed protein (USP) promoter for constitutive, leaf-preferable and seed-specific expressions. The Pc.Ubi and UK398 promoters were PCR amplified and TA-cloned into Gateway 5' entry vector pENTR 5'-TOPO (Invitrogen #K591-20), resulting in pRMW9 (SEQ ID NO: 30) and pRMW 31 (SEQ ID NO: 152) respectively. The primers MW-P17F (AGCTTGACTAGAGAATTCGAATCC) (SEQ ID NO: 28) and MW-P18R (GATCCGGGCTGCACATACATAAC) (SEQ ID NO: 29) were used to amplify the Pc. ubi promoter. The primers MW-P35F (GATCCAATCTCATCCACTGA) (SEQ ID NO: 195) and MW-P36R(CCATGGTTAATTAACCACCA) (SEQ ID NO: 196) were used to amplify the pUK398 promoter. pRLM257 (SEQ ID NO: 153) was the Gateway entry vector containing the USP promoter. pRMW9, pRMW31 and pRLM257 were used in order to generate binary vectors for plant transformation.

Fifteen binary expression vectors (Table 4) were constructed through multi-site Gateway cloning by combining three entry vectors containing a promoter, a gene of interest, a terminator and one destination vector in a LR reaction (Invitrogen #K591-10). The final binary vectors are confirmed by restriction enzyme digestion, PCR, and sequencing.

TABLE 4

Binary vectors for expressing GUS-ta-siRNA in *Arabidopsis*

| Binary Vector | 5' Entry Vector (promoter) | Gene of Interest Vector | 3' Entry Vector (terminator) | Destination Vector |
|---|---|---|---|---|
| pRMW13 (SEQ ID NO: 31 | pRMW9 (SEQ ID NO: 30) (Parsley pUbi4-2) | pRMW5 (GUS-M ta-siRNA) (SEQ ID NO: 242) | pRLM293 (Nos terminator) (SEQ ID NO: 35) | pRLM251 (SEQ ID NO: 36) |
| pRMW14 (SEQ ID NO: 32) | pRMW9 (Parsley pUbi4-2) (SEQ ID NO: 30) | pRMW6 (GUS-C ta-siRNA) (SEQ ID NO: 25) | pRLM293 (Nos terminator) (SEQ ID NO: 35) | pRLM251 (SEQ ID NO: 36) |
| pRMW15 (SEQ ID NO: 33) | pRMW9 (SEQ ID NO: 30) (Parsley pUbi4-2) | pRMW7 (SEQ ID NO: 26) (GUSNMC ta-siRNA | pRLM293 (Nos terminator) (SEQ ID NO: 35) | pRLM251 (SEQ ID NO: 36) |
| pRMW16 (SEQ ID NO: 34) | pRMW9 (SEQ ID NO: 30) (Parsley pUbi4-2) | pRMW8 (SEQ ID NO: 27) (Mock) | pRLM293 (Nos terminator) (SEQ ID NO: 35) | pRLM251 (SEQ ID NO: 36) |
| pRMW17 (SEQ ID NO: 161) | pRMW9 (SEQ ID NO: 30) (Parsley pUbi4-2) | PRMW1 (SEQ ID NO: 23) (ta-siRNA At2g27400) | pRLM293 (Nos terminator) (SEQ ID NO: 35) | pRLM251 (SEQ ID NO: 36) |
| pRMW18 (SEQ ID NO: 154) | pRLM257 (SEQ ID NO: 153) | pRMW5 (GUS-M ta-siRNA) (SEQ ID NO: 242) | pRLM293 (Nos terminator) (SEQ ID NO: 35) | pRLM251 (SEQ ID NO: 36) |
| pRMW19 (SEQ ID NO: 155) | pRLM257 (SEQ ID NO: 153) | pRMW6 (GUS-C ta-siRNA) (SEQ ID NO: 25) | pRLM293 (Nos terminator) (SEQ ID NO: 35) | pRLM251 (SEQ ID NO: 36) |
| pRMW20 (SEQ ID NO: 156) | pRLM257 (SEQ ID NO: 153) | pRMW7 (SEQ ID NO: 26) (GUSNMC ta-siRNA | pRLM293 (Nos terminator) (SEQ ID NO: 35) | pRLM251 (SEQ ID NO: 36) |
| pRMW21 (SEQ ID NO: 157) | pRLM257 (SEQ ID NO: 153) | pRMW8 (SEQ ID NO: 27) (Mock) | pRLM293 (Nos terminator) (SEQ ID NO: 35) | pRLM251 (SEQ ID NO: 36) |
| pRMW22 (SEQ ID NO: 158) | pRLM257 (SEQ ID NO: 153) | PRMW1 (SEQ ID NO: 23) (ta-siRNA At2g27400) | pRLM293 (Nos terminator) (SEQ ID NO: 35) | pRLM251 (SEQ ID NO: 36) |
| pRMW40 (SEQ ID NO: 159) | pRMW31 (SEQ ID NO: 152) | pRMW5 (GUS-M ta-siRNA) (SEQ ID NO: 242) | pRLM293 (Nos terminator) (SEQ ID NO: 35) | pRLM251 (SEQ ID NO: 36) |
| pRMW41 (SEQ ID NO: 160) | pRMW31 (SEQ ID NO: 152) | pRMW6 (GUS-C ta-siRNA) (SEQ ID NO: 25) | pRLM293 (Nos terminator) (SEQ ID NO: 35) | pRLM251 (SEQ ID NO: 36) |
| pRMW42 (SEQ ID NO: 162) | pRMW31 (SEQ ID NO: 152) | pRMW7 (SEQ ID NO: 26) (GUSNMC ta-siRNA | pRLM293 (Nos terminator) (SEQ ID NO: 35) | pRLM251 (SEQ ID NO: 36) |
| pRMW43 (SEQ D NO: 163) | pRMW31 (SEQ ID NO: 152) | pRMW8 (SEQ ID NO: 27) (Mock) | pRLM293 (Nos terminator) (SEQ ID NO: 35) | pRLM251 (SEQ ID NO: 36) |
| pRMW44 (SEQI D NO: 164) | pRMW31 (SEQ ID NO: 152) | PRMW1 (SEQ ID NO: 23) (ta-siRNA At2g27400) | pRLM293 (Nos terminator) (SEQ ID NO: 35) | pRLM251 (SEQ ID NO: 36) |

Notes:

GUS-M ta-siRNA means a ta-siRNA targeted to a 5' region of GUS gene.

GUS-C ta-siRNA means a ta-siRNA targeted to a 3' region of GUS gene.

GUS-NMC ta-siRNA means a pre-ta-siRNA targeted to three different regions in GUS gene.

Parsely ubiquitin promoter (Pc.ubi) indicated Parsley pUbi4-2 in this table.

The 15 binary vectors containing GUS-ta-siRNA were re-transformed into GUS transgenic *Arabidopsis* plants using floral dip method (Weigel and Glazebrook, *Arabidopsis*. A Laboratory Manual, Cold Spring Harbor Laboratory Press, 2002). All the T1 seeds were harvested, surface sterilized, and placed on germination media A-MS-005 (1/2 MS media supplement with 100 nM Pursuit, 10 洞 g/mL Phosphinthricin, 500 洞 g/mL cefotaximine and 2 洞 g/mL benomyl). After cold treatment at 4° C. for 48 hours on germination media, the seeds were grown in Percival chamber at 22° C., 12 hour light/12 hour dark. Plant tissues, including leaves, stems, flowers and siliques, were harvested and stained in GUS staining solution (Jerfferson et al., 1987 EMBO J. 6:3901-3907) at 37° C., overnight. All plant tissues were stained blue due to the GUS activity. No visible color difference was observed between the ta-siRNA/GUS transgenic plants and the parental GUS lines used for transformation. Due to strong GUS expression in parental lines and stability of GUS protein, it is possible that ta-siRNA/GUS caused GUS mRNA reduction but at relatively low efficiency. Designing better 21-nt ta-siRNA/GUS and/or choosing different regions of GUS mRNA to be targeted might improve efficacy of silencing.

The GUS-ta-siRNA transgenic lines are crossed with an *Arabidopsis* mutant line in which one of the key component (SGS3 or RDR6) in ta-siRNA biogenesis pathway is impaired. The GUS expression level is recovered to a similar level as in EW115A transgenic plants, since the production of GUS-ta-siRNA is disrupted.

Similar to above, a tissue-specific promoter (e.g. root-specific promoter) is also used to express GUS-ta-siRNAs in *Arabidopsis* GUS transgenic plants. As a result of expressing GUS-ta-siRNAs in a specific tissue, the GUS signal is down-regulated specifically in a tissue-specific manner.

Example 4. Engineering *Arabidopsis* miR390 Regulated ta-siRNA At3g17185 (TAS3) for Down-Regulating GUS Gene Expression in Transgenic *Arabidopsis* Plants

*Arabidopsis* ta-siRNA gene At3g17185 was PCR amplified from *Arabidopsis* genomic DNA using primers MW-P11F (CCATATCGCAACGATGACGT) (SEQ ID NO: 37) and MW-P12R (GCCAGTCCCCTTGATAGCGA) (SEQ ID NO: 38) followed by TA cloning into PCR8/GW/TOPO vector (Invitrogen #K2500-20). This construct was named pRMW2. In pRMW2 (SEQ ID NO: 39), the 1200 bp of At3g17185 gene contains a 178 bp ta-siRNA region, an 865 bp ta-siRNA upstream region (a potential promoter region) and a 156 bp ta-siRNA downstream region (a potential terminator region). Among the eight 21-nt ta-siRNA phases starting from the position 11 of miR390, two very similar phases, 5'D7(+) and 5'D8(+), were replaced with the same two 21 nt fragments from GUS sequence described in Example 3. These engineered ta-siRNA/GUS precursors were used as entry vectors (Table 5) for generating binary expression vectors (Table 6).

TABLE 5

Gateway entry vectors for engineering TAS3 ta-siRNA targeting to GUS.

| Construct Name | Engineered 5'D7(+) Sequence | Engineered 5'D8(+) Sequence |
|---|---|---|
| pRMW53 (SEQ ID NO: 166) | taatcgcctgtaagtgcactc (Target GUS M1346) | taatcgcctgtaagtgcactc (Target GUS M1346) |
| pRMW54 (SEQ ID NO: 167) | ttaccatccgtaataacagtc (Target GUS C1585) | ttaccatccgtaataacagtc (Target GUS C1585) |
| PRMW38 (SEQ ID NO: 165) | tcttgaccttgtaagacccca (wild-type TAS3 5'D7 sequence) | tcttgaccttgtaaggccttt (wild-type TAS3 5'D8 sequence) |

Note:
GUS M1346 indicates the position 1346 in the middle of GUS.
GUS C1585 indicates the position 1586 in the C-terminus of GUS.

Two promoters (Pc.ubi and UK398, described in Example 3) were used to express TAS3 ta-siRNA targeting GUS in *Arabidopsis*. Six binary vectors were constructed by multiple-site Gateway cloning (Table 6). The final binary vectors were confirmed by restriction enzyme analysis and sequencing.

TABLE 6

Binary vectors for expressing TAS3 ta-siRNA targeting GUS

| Binary Vector | 5' Entry Vector (promoter) | Gene of Interest Vector | 3' Entry Vector (terminator) | Destination Vector |
|---|---|---|---|---|
| pRMW74 (SEQ ID NO: 169) | pRMW9 (SEQ ID NO: 30) (Parsley pUbi4-2) | pRMW53 (GUS-M ta-siRNA) (SEQ ID NO: 166) | pRLM293(Nos terminator) (SEQ ID NO: 35) | pRLM402 (SEQ ID NO: 174) |
| pRMW75 (SEQ ID NO: 170) | pRMW9 (SEQ ID NO: 30) | pRMW54 (GUS-C ta-siRNA) | pRLM293 (Nos terminator) | pRLM402 (SEQ ID NO: 174) |

TABLE 6-continued

Binary vectors for expressing TAS3 ta-siRNA targeting GUS

| Binary Vector | 5' Entry Vector (promoter) | Gene of Interest Vector | 3' Entry Vector (terminator) | Destination Vector |
|---|---|---|---|---|
| | (Parsley pUbi4-2) | (SEQ ID NO: 167) | (SEQ ID NO: 35) | |
| pRMW76 (SEQ ID NO: 168) | pRMW9 (SEQ ID NO: 30) (Parsley pUbi4-2) | PRMW38 (ta-siRNA TAS3) (SEQ ID NO: 165) | pRLM293(Nos terminator) (SEQ ID NO: 35) | pRLM402 (SEQ ID NO: 174) |
| pRMW77 (SEQ ID NO: 172) | pRMW31 (SEQ ID NO: 152) (*Arabidopsis* pUK398 promoter) | pRMW53 (GUS-M ta-siRNA) (SEQ ID NO: 166) | pRLM293(Nos terminator) (SEQ ID NO: 35) | pRLM402 (SEQ ID NO: 174) |
| pRMW78 (SEQ ID NO: 173) | pRMW31 (SEQ ID NO: 152) (*Arabidopsis* pUK398 promoter) | pRMW54 (GUS-C ta-siRNA) (SEQ ID NO: 167) | pRLM293(Nos terminator) (SEQ ID NO: 35) | pRLM402 (SEQ ID NO: 174) |
| pRMW79 (SEQ ID NO: 71) | pRMW31 (SEQ ID NO:1 52) (*Arabidopsis* pUK398 promoter) | PRMW38 (ta-siRNA TAS3) (SEQ ID NO: 165) | pRLM293(Nos terminator) (SEQ ID NO: 35) | pRLM402 (SEQ ID NO: 174) |

Note:
Parsely ubiquitin promoter (Pc.ubi) indicated Parsley pUbi4-2 in this table.

These six binary vectors were transformed into transgenic GUS *Arabidopsis* plants driven by the Pc.ubi promoter using floral dip method (Weigel and Glazebrook, *Arabidopsis*. A Laboratory Manual, Cold Spring Harbor Laboratory Press, 2002). As a result of the expression of ta-siRNA/GUS, expression level of GUS is reduced. As in Example 3, the ta-siRNA transgenic plants are crossed with *Arabidopsis* mutant sgs3 or rdr6, and the expression level of GUS gene is recovered to a similar level to that in the parental GUS transgenic plants.

Example 5. Engineering *Arabidopsis* miR173 regulated ta-siRNA At2g27400 (TAS1a) for Down-Regulating Phytoene Desaturase (PDS) Gene Expression in *Arabidopsis* Plants The same ta-siRNA At2g27400 gene described in Example 3 was engineered to target to an *Arabidopsis* endogenous PDS gene (Accession #AF360196). The same 21-nt ta-siRNA phases, 3'D2(+), 3'D4(+) and 3'D6(+) were replaced with 21-nt sequences from *Arabidopsis* PDS gene (Table 7). These four constructs were used as gene of interest Gateway entry vectors in order to generate binary vectors for plant transformation. PDS1, PDS2, PDS3 and PDS4 refer to different regions of PDS mRNA to be targeted by engineered ta-siRNAs.

TABLE 7

Gateway entry vectors for engineered ta-siRNA targeting to PDS gene.

| Construct Name | Engineered 3'D2(+) sequence | Engineered 3'D4(+) Sequence | Engineered 3'D6(+) sequence |
|---|---|---|---|
| pRMW27 (SEQ ID NO: 43) | ttcttgtcttaagcgcttgag (PDS1) (target PDS 247-267) | ttcttgtcttaagcgcttgag (PDS1) (target PDS 247-267) | ttcttgtcttaagcgcttgag (PDS1) (target PDS 247-267) |
| pRMW23 (SEQ ID NO: 40) | ttcctgaagaaaccggttcaa (PDS2) (target PDS 987-1007) | ttcctgaagaaaccggttcaa (PDS2) (target PDS 987-1007) | ttcctgaagaaaccggttcaa (PDS2) (target PDS 987-1007) |
| PRMW39 (SEQ ID NO: 176) | tcatatgtgttcttcagtttt (PDS3) (target PDS 1331-1351) | tcatatgtgttcttcagtttt (PDS3) (target PDS 1331-1351) | tcatatgtgttcttcagtttt (PDS3) (target PDS 1331-1351) |
| PRMW24 (SEQ ID NO: 41) | ttacaagttaaggacatgtcg (PDS4) (target PDS 1394-1414) | ttacaagttaaggacatgtcg (PDS4) (target PDS 1394-1414) | ttacaagttaaggacatgtcg (PDS4) (target PDS 1394-1414) |

To express PDS-ta-siRNA in *Arabidopsis*, three promoters were chosen: parsley ubiquitin promoter (Pc.ubi), *Arabidopsis* leaf-preferable promoter (UK398, EP 01666599 and US 20060156429), and faba bean unknown seed protein (USP) promoter for constitutive, leaf-preferable, and seed-specific expressions. The Pc. ubi and UK398 promoters were PCR amplified and TA-cloned into Gateway 5' entry vector pENTR 5'-TOPO (Invitrogen #K591-20), resulting in pRMW9 (SEQ ID NO: 30) and pRMW 31 (SEQ ID NO: 152), respectively. The primers MW-P17F (AGCTT- GACTAGAGAATTCGAATCC) (SEQ ID NO: 28) and MW-P18R (GATCCGGGCTGCACATACATAAC) (SEQ ID NO: 29) were used to amplify the Pc. ubi promoter. The primers MW-P35F (GATCCAATCTCATCCACTGA) (SEQ ID NO: 195) and MW-P36R(CCATGGTTAATTAAC-CACCA) (SEQ ID NO: 196) were used to amplify the UK398 promoter. pRLM257 (SEQ ID NO: 153) was the Gateway entry vector for the USP promoter. pRMW9, pRMW31 and pRLM257 were used for generating binary vector for plant transformation. Nine binary expression vectors (Table 8) were constructed through multi-site Gateway cloning by combining three entry vectors containing a promoter, a gene of interest, a terminator and one destination vector in a LR reaction (Invitrogen #K591-10). The final binary vectors were confirmed by restriction enzyme digestion and sequencing.

TABLE 8

Binary vectors for expressing ta-siRNA/PDS in *Arabidopsis*

| Binary Vector | 5' Entry Vector (Promoter) | Gene of Interest Vector | 3' Entry vector (Terminator) | Destination Vector |
|---|---|---|---|---|
| pRSM1 (SEQID NO: 177) | pRMW31 (SEQ ID NO: 152) (*Arabidopsis* pUK398 promoter) | pRMW23 (SEQ ID NO: 40) (TAS1/PDS2) | pRLM293 (SEQ ID NO: 35) (NOS terminator) | pRLM402 (SEQ ID NO: 174) |
| pRSM2 (SEQ ID NO: 178) | pRMW31 (SEQ ID NO: 152) (*Arabidopsis* pUK398 promoter) | pRMW24 (SEQ ID NO: 41) (TAS1/PDS4) | pRLM293 (SEQ ID NO: 35) (NOS terminator) | pRLM402 (SEQ ID NO: 174) |
| pRSM3 (SEQ ID NO: 179) | pRMW31 (SEQ ID NO: 152) (*Arabidopsis* pUK398 promoter) | pRMW27 (SEQ ID NO: 43) (TAS1/PDS1) | pRLM293 (SEQ ID NO: 35) (NOS terminator) | pRLM402 (SEQ ID NO: 174) |
| pRSM4 (SEQ ID NO: 180) | pRMW31 (SEQ ID NO: 152) (*Arabidopsis* pUK398 promoter) | PRMW39 (SEQ ID NO: 176) (TAS1/PDS3) | pRLM293 (SEQ ID NO: 35) (NOS terminator) | pRLM402 (SEQ ID NO: 174) |
| pRSM5 (SEQ ID NO: 181) | pRMW9 (SEQ ID NO: 30) (Parsley pUbi4-2 promoter) | pRMW23 (SEQ ID NO: 40) (TAS1/PDS2) | pRLM293 (SEQ ID NO: 35) (NOS terminator) | pRLM402 (SEQ ID NO: 174) |
| PRSM6 (SEQ ID NO: 182) | pRMW9 (SEQ ID NO: 30) (Parsley pUbi4-2 promoter) | pRMW24 (SEQ ID NO: 41) (TAS1/PDS4) | pRLM293 (SEQ ID NO: 35) (NOS terminator) | pRLM402 (SEQ ID NO: 174) |
| PRSM7 (SEQ ID NO: 183) | pRMW9 (SEQ ID NO: 30) (Parsley pUbi4-2 promoter) | pRMW27 (SEQ ID NO: 43) (TAS1/PDS1) | pRLM293 (SEQ ID NO: 35) (NOS terminator) | pRLM402 (SEQ ID NO: 174) |
| PRSM8 (SEQ ID NO: 184) | pRMW9 (SEQ ID NO: 30) (Parsley pUbi4-2 promoter) | PRMW39 (SEQ ID NO: 176) (TAS1/PDS3) | pRLM293 (SEQ ID NO: 35) (NOS terminator) | pRLM402 (SEQ ID NO: 174) |
| PRMW111 (SEQ ID NO: 185) | pRLM257 (SEQ ID NO: 153) (pUSP promoter) | PRMW39 (SEQ ID NO: 176) (TAS1/PDS3) | pRLM293 (SEQ ID NO :35) (NOS terminator) | pRLM402 (SEQ ID NO: 174) |

Note:
Parsely ubiquitin promoter (Pc.ubi) indicated Parsley pUbi4-2 in this table.

These binary vectors were transformed in both wild-type *Arabidopsis* Columbia-0 and *Arabidopsis* mutants sgs3-12 or rdr6-14 (using floral dip method (Weigel and Glazebrook, *Arabidopsis*. A Laboratory Manual, Cold Spring Harbor Laboratory Press, 2002). All the T1 seeds except for pMW111 transgenic lines were harvested, surface sterilized, and placed on germination media A-MS-007 (1/2 MS media, 3% sucrose, 0.5 g/L MES, supplement with 10 泀 g/mL-phosphinothricin, 500 泀 g/mL cefotaximine, 2 泀 g/mL benomyl). After cold treatment at 4° C. for 48 hours on germination media, the seeds were grown in Percival chamber at 22° C., 12 hour light/12 hour dark. Seedlings with various degrees of photo-bleaching phenotypes, a typical phenotype for knocking-out or down-regulating PDS gene in plants, were observed after 7 days growing on selection media in Percival chamber. These phenotypes continued to develop as plants became mature. Photo-bleaching phenotypes were classified into 4 categories: white (W), pale green (PG), mainly green (MG) and green (G). Table 9 summarized the phenotypes in 3-week old transgenic plants. Some seedlings with very severe photo-bleaching phenotype stopped growing at after 7 days germination and they were included in the white phenotype in the table.

TABLE 9

Percentage of TAS1/PDS transgenic plants showed photo-bleaching phenotype

| | pUbi promoter | | | | pUK398 promoter | | | |
|---|---|---|---|---|---|---|---|---|
| Phenotype | W | PG | MG | G | W | PG | MG | G |
| TAS1/PDS1 | 53% | 13% | 35% | 0% | 46% | 31% | 23% | 0% |
| TAS1/PDS2 | 70% | 30% | 0% | 0% | 76% | 6% | 0% | 18% |
| TAS1/PDS3 | 82% | 6% | 12% | 0% | 81% | 12% | 3% | 4% |
| TAS1/PDS4 | 20% | 24% | 52% | 4% | 64% | 21% | 0% | 14% |

Note:
For each data point, 13-68 plants were analyzed.

The data from Table 9 indicated that all four engineered ta-siRNA/PDS constructs targeting different regions of PDS mRNA were able to cause photo-bleaching phenotypes. When highly conserved coding region of plant PDS genes were target by engineered ta-siRNAs (i.e. ta-siRNA/PDS2 and ta-siRNA/PDS3), majority of transgenic plants expressing such ta-siRNAs showed the most sever phenotype (i.e. white). It is possible that the engineered ta-siRNAs targeting conserved regions have stronger effect on gene silencing than targeting other regions of a gene-of-interest.

It has been shown that RDR6 and SGS3 gene are required for ta-siRNA biogenesis. When ta-siRNA/PDS constructs were transformed into rdr6-14 or sgs3-12 mutant plants, none of transgenic plants showed photo-bleaching phenotypes. This result indicated that in a wild-type background, the photo-bleaching phenotype was indeed caused by engineered ta-siRNA targeting PDS.

Q-RT-PCR analysis was further carried out to detect PDS mRNA level in transgenic plants and *Arabidopsis* GAPDH (AY039539) and Actin 2 (NM112764) gene expression were used as endogenous controls for data analysis.

The primers and probes used were:

PDS forward primer MW-P83F (TTGGAGAACT-TGGGATCAATG) (SEQ ID NO: 211), PDS reverse primer MW-P84R (GGCATAGCAAAAATCATGGAG) (SEQ ID NO: 212), PDS Taqman probe #86 (GCAGTGGA) (SEQ ID NO: 214) from Roche Applied Science Q-RT-PCR universal probe library (cat# 04689119001);

GAPDH forward primer MW-P71F (TCGAGGGAACAG-GAGTGTTT) (SEQ ID NO: 197), GAPDH reverse primer MW-P72R(CTCCGGCTTGGATATGCTT) (SEQ ID NO: 198), GAPDH taqman probe #68 (AGGAGCAG) (SEQ ID NO: 207) from Roche Applied Science Q-RT-PCR universal probe library (cat# 04688678001);

Actin 2 forward primer MW-P67F (TCCTTGTACGC-CAGTGGTC) (SEQ ID NO: 199), Actin 2 reverse primer MW-P68R(CACGTCCAGCAAGGTCAAG) (SEQ ID NO: 200), Actin 2 Taqman probe #88 (CATCCTCC) (SEQ ID NO: 208) from Roche Applied Science Q-RT-PCR universal probe library (cat# 04689135001)

Total RNA was purified from plants using Trizol Reagent (Invitrogen, #15596-026). Fifteen ng of the total RNA was used in reverse transcription reaction (15 洞L) using reverse primers and MultiScripe Reverse Transcriptase (Applied Biosystems, # 4139983) according to the manufacturer protocol. The conditions for reverse transcription reaction were: 16° C. 30 min, 42° C. 30 min, and 85° C. 5 min. Real time PCR was carried out using ABI 7900 and the 2× Universal Taqman Master mix (Applied Biosystems, # 4324018). As a template, 1.33 洞L out of 15 洞L RT reaction was used in 20 μL PCR reaction. The conditions for PCR reaction was: 95° C. 10 min, then 95° C. 15 seconds, 60° C. 60 seconds for 40 cycles. Table 10 and 11 showed the results of Q-RT-PCR analysis for the expression level of endogenous PDS gene in the transgenic plants carrying ta-siRNA/PDS constructs.

TABLE 10

Q-RT-PCR analysis of PDS mRNA from 5-week old transgenic plants carrying engineered ta-siRNA/PDS

| Construct | Phenotype | Transgenic event | Relative Expression of PDS |
|---|---|---|---|
| PRSM7(TAS1a/PDS1) | White | #75-1 | 1.06 |
| (SEQ ID NO: 183) | White | #75-2 | 1.39 |
| | Pale Green | #75-7 | 1.00 |
| | Pale Green | #75-8 | 1.47 |
| | Mainly Green | #75-23 | 4.34 |
| | Mainly Green | #75-24 | 2.34 |
| | Green | #75-39 | 8.05 |
| | Green | #75-40 | 4.32 |
| PRMW17(TAS1a) | Green | #80-1 | 36.86 |
| (SEQ ID NO: 161) | Green | #80-2 | 13.63 |
| None | Green | Col-0 wild-type #1 | 10.25 |
| | Green | Col-0 wild-type #2 | 9.53 |

Note:
PDS expression was normalized against *Arabidopsis* GAPDH expression.

As shown in Table 10, transgenic plants expressing engineered ta-siRNA (TAS1a/PDS1) had a significantly reduced PDS mRNA level compared to the wild-type Col-0 plants and the transgenic plants expressing wild-type ta-siRNA (TAS1a). In addition, the reduction in expression of PDS by ta-siRNA/PDS in transgenic plants was correlated with severity of photo-bleaching phenotypes, i.e. the lowest PDS level was detected in white plants (about 12% of Col-0 PDS level and 5% of wild-type TAS1 transgenic) and the highest PDS level was detected in green plants (63% of Col-0 plants and 25% of wild-type TAS1 transgenic plants).

TABLE 11

PDS Q-RT-PCR analysis of 7-week old transgenic plants carrying engineered ta-siRNA/PDS

| Construct | Phenotype | Genetic background | Transgenic event | PDS relative expression level |
|---|---|---|---|---|
| PRSM5(TAS1a/PDS2) (SEQ ID NO: 181) | white | Col-0 | #67-2 | 1.00 |
| | white | | #67-3 | 0.90 |
| | pale green | | #67-14 | 4.64 |
| | pale green | | #67-23 | 4.27 |
| | mainly green | | #67-25 | 18.05 |
| | mainly green | | #67-32 | 21.69 |
| PRSM5(TAS1a/PDS2(SEQ ID NO: 181) | green | rdr6-14 | #68-1 | 54.72 |
| | green | | #68-2 | 96.39 |
| None | green | Col-0 | #1 | 42.53 |
| | green | | #2 | 138.62 |
| None | green | rdr6-14 | #1 | 21.73 |
| | green | | #2 | 22.84 |

Note:
PDS expression was normalized to *Arabidopsis* GAPDH expression

As shown in Table 11, under the Col-0 genetic background, the PDS mRNA levels were also reduced significantly in transgenic plants carryingTAS1a/PDS2, with the lowest PDS mRNA levels in white plants (0.23% of Col-0) and the highest level in green plants (57% of Col-0). However, the PDS mRNA levels in the transgenic plants carrying the same transgene but in rdr6-14 background were not reduced. Together with Table 10, these results indicate that the PDS mRNA level was significantly reduced in the transgenic plants carrying engineered ta-siRNAs targeting PDS mRNA at different regions (i.e. PDS1 or PDS2). Furthermore, such reduction was dependent upon functional RDR6, which is consistent with the role of RDR6 in ta-siRNA production.

To confirm PDS ta-siRNAs were produced in the TAS1a/PDS1 plants, a real time PCR method was performed that is a modification of miRNA detection protocol (Shi and Chiang, 2005 Biotechniques 39:519-25). Four 洞g of total RNA from each of the 12 plants in Table 10 were diluted to 45 洞L in $H_2O$. The RNAs were treated with DNase (DNA-free kit, Ambion, cat# 1906) according to the manufacture's protocol. The final recovered volume of the DNase treated RNAs was 45 洞L each. Poly(A) tails were added to the DNase treated RNAs with *E. coli* Poly(A) Polymerase I (E-PAP) using Ambion's Poly(A) tailing kit (cat# 1350). To each 45 洞L of DNase treated RNA, 11 洞L of $H_2O$, 20 洞L of 5× E-PAP Buffer, 10 洞L of 25 mM $MnCl_2$, 10 洞L of 10 mM ATP, and 4 洞L of E-PAP enzyme were added and the reactions incubated at 37° C. for 1 hour. The Poly(A) tailed RNA reactions were column purified using reagents from Ambion's Megascript RNAi kit (cat# 1626). To each 100 洞L Poly(A) tail reaction was added, 50 洞L of 10× Binding Buffer, 100 洞L of $H_2O$, and 250 洞L of 100% ETOH, and this mixture was transferred to a cartridge placed in a collection tube. The cartridge was spun at 10,000×g for 2 min then washed twice with 500 洞L 2× Wash Buffer. RNA was recovered with 100 洞L of $H_2O$ preheated to 95° C. A 3' adaptor sequence was added to the poly(A) tailed RNA by reverse transcription using Invitrogen's Reverse Transcriptase III kit (cat# 18080-051). To 8 洞L of each poly(A) tailed RNA, was added 1 洞L of JD-dT 77 primer:

```
                                                       (SEQ ID NO: 205)
(5'-GCGAGCACAGAATTAATACGACTCACTCCACCACCATAGGTTTTTTTTTTTTVN-3',
V = A, C or G, N = A, C, G or T),
```

and 1 洞L of 10 mM dNTPs. These mixtures were incubated at 65° C. for 5 min then placed on ice. To each mixture was added 2 洞L of 10×RT Buffer, 4 洞L of 25 mM $MgCl_2$, 2 洞L of 0.1M DTT, 1 洞L of RNaseOUT, and 1 洞L of Superscript III RT. The reactions were incubated at 42° C. for 1 hour and the reactions terminated by incubating at 85° C. for 5 min, then the reactions placed on ice. 60 洞L of $H_2O$ was then added to each reaction.

Real-time PCR to detect PDS ta-siRNA was performed in a 96-well PCR plate as follows. Each reaction contained 1 洞L of the reverse transcribed RNA, 6.6 洞L $H_2O$, 10 洞L Taqman PCR Master Mix (ABI cat# 4324-018), 1 洞L of a reverse primer JD-Rev#77 (5' GCGAGCACAGAATTAATAC 3') (SEQ ID NO: 209) that is complementary to a portion of the 3' adaptor sequence, 0.4 洞L of ABI Taqman probe Human#77 (5'-GGTGGTGG-3', locked nucleic acids) (SEQ ID NO: 206), and 1 洞L of a forward oligo, either MW-P92 (5'-ATTCATTCTTGTCTTAAGCGC-3') (SEQ ID NO: 201) or MW-P99 (5'-GAAAGTGACTACATCGGGGAA-3') (SEQ ID NO: 202). The 3' most 16 nucleotides of MW-P92 are identical to bases 1-16 of the PDS1 21 nt ta-siRNA and MW-P99 is identical to *Arabidopsis* miR166 and used as a positive control for the assay. Real-time PCR was carried with an ABI 7000 using the parameters 5 min 95° C., (15 sec 95° C., 1 min 60° C.) 40 cycles. The relative amount of PDS ta-siRNA for each plant was normalized to miR166, calculated using Ct values.

TABLE 12

Relative amount of ta-siRNA/PDS in transgenic plants.

| Construct | Phenotype | Transgenic event | Relative amount of ta-siRNA/PDS |
|---|---|---|---|
| PRSM7(TAS1a/PDS1) | White | #75-1 | 24.3 |
| (SEQ ID NO: 183) | White | #75-2 | 11.8 |
| | Pale Green | #75-7 | 10.6 |
| | Pale Green | #75-8 | 5.8 |
| | Mainly Green | #75-23 | 1.4 |
| | Mainly Green | #75-24 | 3.2 |
| | Green | #75-39 | 1.0 |
| | Green | #75-40 | 1.7 |
| PRMW17(TAS1a) | Green | #80-1 | 0 |
| (SEQ ID NO: 161) | Green | #80-2 | 0 |
| None | Green | Col-0 wild-type #1 | 0 |
| | Green | Col-0 wild-type #2 | 0 |

Table 12 shows that PDS ta-siRNA was only detected from the transgenic plants carrying engineered ta-siRNA/PDS but not in the transgenic plants carrying a control vector (i.e. wild-type TAS1 gene with no engineered ta-siRNA) and Col-0 wild-type *Arabidopsis*. Further more, the amount of PDS ta-siRNA was directly correlated to the degree of phenotypes and the reduction of PDS gene, i.e. the more production of ta-siRNA/PDS, the more reduction of PDS mRNA, and the more severe of photo-bleaching phenotype in the transgenic plants. Taken together, our data demonstrated that the engineering of miR173-directed ta-siRNA down-regulates expression of the gene-of-interest.

Example 6: Engineering *Arabidopsis* miR390 Regulated ta-siRNA At3g17185 (TAS3) for Down-Regulating PDS Gene Expression in *Arabidopsis* Plants The same ta-siRNA At3g17185 (TAS3) described in Example 4 was engineered to target to an *Arabidopsis* endogenous PDS gene (Accession #AF360196). The 21-nt ta-siRNA phases, 5'D7(+) and 5'D8(+), were replaced with 21-nt sequences (PDS2, PDS3 and PDS4, see Example 5, Table 7) homologous to the coding regions *Arabidopsis* PDS gene. These three constructs were used as gene of interest Gateway entry vectors in generating binary vectors for plant transformation (Table 13). TAS3/PDS refers to transgenes with engineered ta-siRNA phases targeting PDS, and TAS3/PDS2, TAS3/PDS3 and TAS3/PDS4 specify the regions of PDS mRNA to be targeted, i.e. PDS2, PDS3 and PDS4.

TABLE 13

| Gateway entry vector containing engineered ta-siRNA targeting PDS mRNA | | |
|---|---|---|
| Construct Name | Engineered 5'D7(+) Sequence | Engineered 5'D8(+) Sequence |
| pRMW51 (SEQ ID NO: 186) | ttcctgaagaaaccggttcaa (PDS2) (target PDS 987-1007) | ttcctgaagaaaccggttcaa (PDS2) (target PDS 987-1007) |
| pRMW52 (SEQ ID NO: 187) | ttacaagttaaggacatgtcg (PDS4) (target PDS 1394-1414) | ttacaagttaaggacatgtcg (PDS4) (target PDS 1394-1414) |
| pRMW109 (SEQ ID NO: 188) | tcatatgtgttcttcagtttt (PDS3) (target PDS 1331-1351) | tcatatgtgttcttcagtttt (PDS3) (target PDS 1331-1351) |

As described in Example 5, the Pc.Ubi, UK398, and USP promoters were used to express the TAS3/PDS in *Arabidopsis*. Six binary vectors were generated through Gateway multiple-site cloning (Table 14). These final binary expression vectors were confirmed by restriction enzyme analysis and sequencing.

TABLE 14

| Binary vectors for expressing TAS3/PDS in *Arabidopsis* | | | | |
|---|---|---|---|---|
| Binary Vector | 5' Entry vector (promoter) | Gene of Interest Vector | 3' Entry Vector (terminator) | Destination Vector |
| pRMW80 (SEQ ID NO: 189) | pRMW9 (SEQ ID NO: 30) (Parsley pUbi4-2 promoter) | pRMW51 (SEQ ID NO: 186) (TAS3/PDS2) | pRLM293 (SEQ ID NO: 35) (NOS terminator) | pRLM402 (SEQ ID NO: 174) |
| pRMW81 (SEQ ID NO: 190) | pRMW9 (SEQ ID NO: 30) (Parsley pUbi4-2 promoter) | pRMW52 (SEQ ID NO: 187) (TAS3/PDS4) | pRLM293 (SEQ ID NO: 35) (NOS terminator) | pRLM402 (SEQ ID NO: 174) |
| pRMW82 (SEQ ID NO: 191) | pRMW31 (SEQ ID NO: 152) (*Arabidopsis* pUK398 promoter) | pRMW51 (SEQ ID NO: 186) (TAS3/PDS2) | pRLM293 (SEQ ID NO: 35) (NOS terminator) | pRLM402 (SEQ ID NO: 174) |
| pRMW83 (SEQ ID NO: 192) | pRMW31 (SEQ ID NO: 152) (*Arabidopsis* pUK398 promoter) | pRMW52 (SEQ ID NO: 187) (TAS3/PDS4) | pRLM293 (SEQ ID NO: 35) (NOS terminator) | pRLM402 (SEQ ID NO: 174) |
| PRMW110 (SEQ ID NO: 193) | pRMW9 (SEQ ID NO: 30) (Parsley pUbi4-2 promoter) | pRMW109 (SEQ ID NO: 188) (TAS3/PDS3) | pRLM293 (SEQ ID NO: 35) (NOS terminator) | pRLM402 (SEQ ID NO: 174) |
| PRMW112 (SEQ ID NO: 194) | pRLM257 (SEQ ID NO: 153) (pUSP promoter) | pRMW109 (SEQ ID NO: 188) (TAS3/PDS3) | pRLM293 (SEQ ID NO: 35) (NOS terminator) | pRLM402 (SEQ ID NO: 174) |

Note:
Parsely ubiquitin promoter (Pc.ubi) indicated Parsley pUbi4-2 in this table.

These engineered TAS3/PDS were transformed into both wild-type *Arabidopsis* Col-0 and *Arabidopsis* mutants sgs3-12 or rdr6-14 using floral dip method (Weigel and Glazebrook, *Arabidopsis*. A Laboratory Manual, Cold Spring Harbor Laboratory Press, 2002). All the T1 seeds except for pMW110 and pRMW112 transgenic lines were harvested, surface sterilized and placed on germination media A-MS-007 (1/2 MS media, 3% sucrose, 0.5 g/L MES, supplement with 10 洞g/mL Phosphinothricin, 500 洞g/mL Cefotaximine, 2 洞g/mL Benomyl). After cold treatment at 4° C. for 48 hours on germination media, the seeds were grown in Percival chamber at 22° C., 12 hour light/12 hour dark. Seedlings with photo-bleaching phenotypes, typical phenotypes for knocking-out or down-regulating PDS gene in plants, were observed after 7-8 days growing on selection media in Percival chamber. These photo-bleaching phenotypes appeared to be stronger in younger plants. It gradually reduced when plants became older. Using the similar system to that described in Example 5, we categorized the TAS3/PDS phenotype into three groups: pale green (PG), mainly green (MG) and green (G). Table 12 summarized the phenotypes in 18-days old transgenic plants.

TABLE 15

Percentage of TAS3/PDS transgenic plants showed photo-bleaching phenotype

| | pUbi promoter | | | pUK398 promoter | | |
|---|---|---|---|---|---|---|
| | PG | MG | G | PG | MG | G |
| TAS3/PDS2 | 21% | 57% | 21% | 0% | 0% | 100% |
| TAS3/PDS4 | 0% | 11% | 89% | 0% | 0% | 100% |

TABLE 15-continued

Percentage of TAS3/PDS transgenic plants showed photo-bleaching phenotype

| | pUbi promoter | | | pUK398 promoter | | |
|---|---|---|---|---|---|---|
| | PG | MG | G | PG | MG | G |

Note:
The number of plants used to analyze phenotypes varied from 15-37 plants for each construct, depending on the transformation efficiency.

The data from this table indicated that both TAS3/PDS2 and TAS3/PDS4 were able to produce PDS-related photo-bleaching phenotypes. Consistent with the data in TAS1/PDS experiments described in Example 5, PDS2 ta-siRNA appeared to have stronger effect on silencing PDS gene in *Arabidopsis* than PDS4.

To confirm if the photo-bleaching phenotypes were caused by the engineered ta-siRNA targeting to the endogenous PDS gene, we also transformed the TAS3/PDS into rdr6-14 or sgs3-12 mutant plants in which the ta-siRNA biogenesis pathway was disrupted due to the mutation in RDR6 or SGS3. No photo-bleaching phenotype was observed in the sgs3-12 or rdr6-14 mutant. This result indicates that the photo-bleaching phenotypes were caused by the engineered ta-siRNA targeting to the endogenous PDS gene.

As described in Example 5, the expression of the endogenous PDS gene in the transgenic plants was measured by using Q-RT-PCR. Table 16 showed that the PDS mRNA level was significantly reduced in TAS3/PDS transgenic plants in the Col-0 genetic background, but not in the rdr6-14 background. This result indicates that the reduction of the endogenous PDS gene expression was achieved through ta-siRNA biogenesis pathway. Further more, the degree of reduction on the PDS gene expression was correlated with the photo-bleaching phenotypes. The average PDS gene expression levels in the pale green plants were about 3.5% of Col-0 plants, in the mainly green plants was about 10% of the Col-0 plants.

TABLE 16

PDS Q-RT-PCR analysis of 8-week old transgenic plants carrying TAS3/PDS2 (normalized against *Arabidopsis* Actin 2)

| Phenotype | Genetic Background | Transgenic event | Rep. 1 | Rep. 2 | Average | Standard Deriviation |
|---|---|---|---|---|---|---|
| Pale Green | Col-0 | MW80-4 | 0.01 | 0.00 | 0.00 | 0.01 |
| Pale Green | Col-0 | MW80-7 | 0.02 | 0.00 | 0.01 | 0.01 |
| Pale Green | Col-0 | MW80-10 | 0.00 | 0.00 | 0.00 | 0.00 |
| Mainly Green | Col-0 | MW80-8 | 0.00 | 0.00 | 0.00 | 0.00 |
| Mainly Green | Col-0 | MW80-5 | 0.11 | 0.00 | 0.06 | 0.08 |
| Mainly Green | Col-0 | MW80-6 | 0.02 | 0.00 | 0.01 | 0.01 |
| Green | rdr6 | MW80-1 | 0.08 | 0.00 | 0.04 | 0.06 |
| Green | rdr6 | MW80-2 | 0.17 | 0.06 | 0.12 | 0.08 |
| Green | Col-0 | MW82-1 | 0.26 | 0.02 | 0.14 | 0.17 |
| Green | Col-0 | MW82-2 | 0.06 | 0.00 | 0.03 | 0.04 |
| Green | Col-0 | MW82-7 | 0.05 | 0.02 | 0.04 | 0.02 |
| Green | Col-0 | MW82-8 | 0.05 | 0.01 | 0.03 | 0.03 |
| Green | Col-0 | MW82-9 | 0.23 | 0.19 | 0.21 | 0.02 |
| Green | rdr6 | MW82-1 | 0.35 | 0.30 | 0.33 | 0.03 |
| Green | rdr6 | MW82-2 | 0.31 | 0.27 | 0.29 | 0.03 |
| Green | Col-0 | 1 | 0.28 | 0.20 | 0.24 | 0.06 |
| Green | Col-0 | 2 | 0.16 | 0.17 | 0.17 | 0.01 |
| Green | rdr6 | 1 | 0.24 | 0.20 | 0.22 | 0.03 |
| Green | rdr6 | 2 | 0.18 | 0.15 | 0.17 | 0.02 |

Note:
MW80 transgenic plants were transformed with pRMW80.
MW82 transgenic plants were transformed with pRMW82.

A real-time PCR method was used to detect PDS2 ta-siRNA in plants MW80-4, MW80-7, MW80-10, MW80-8, MW80-5 and MW80-6 essentially as in Example 5 with the following exceptions. Starting material was 3 μg of total RNA for each sample diluted to 45 μL in H$_2$O. DNase treatment and poly(A) tail additions to the RNA samples were performed as described in Example 5. The poly(A) tailed reactions were purified using reagents from Statagene's Miracle miRNA Isolation Kit (cat# 400815). 260 μL of lysis buffer and 40 μL of 2M NaAcetate were added to the 100 μL of each poly(A) tail reaction. 933 μL 100% ETOH was added and the mixture transferred to a spin cup in a collection tube and centrifuged at 16,000×g for 30 sec to bind the poly (A) tailed RNA to the spin cup. The spin cup was washed 3 times with 600 μL of Low Salt Wash Buffer. The poly(A) tailed RNAs were eluted with 100 μL of H$_2$O pre-warmed to 60° C. The purified poly(A) tailed RNAs were reverse transcribed with the JD-dT#77 primer (SEQ ID NO: 205) (Example 5) using Invitrogen's SuperScript III First-Strand Synthesis SuperMix (cat# 18080-400) as follows. To 8 μL of purified poly(A) tailed RNA, 1 μL of JD-dT#77 primer (50 μM) and 1 μL of Annealing Buffer was added and the mixture heated at 65° C. for 5 min then put on ice. To this mixture was added 10 μL 2× First Strand Reaction Mix and 2 μL Superscript III/RNaseOUT Enzyme Mix. The reaction was incubated at 42° C. for 1 hour and the reaction terminated at 85° C. for 7 min.

PDS2 ta-siRNA was detected by real-time PCR described in Example 5 except the forward oligos used were MW-P129 (5'-TTCAATTCCTGAAGAAACCGG-3') (SEQ ID: 203) and MW-P99 (GAAAGTGACTA-CATCGGGGAA) (SEQ ID NO: 202) (Example 5). The 3' most 16 nucleotides of MW-P129 are identical to bases 1-16 of the PDS2 21 nt ta-siRNA and MW-P99 is identical to *Arabidopsis* miR166 and used as a positive control for the assay. Real-time PCR was carried with an ABI 7000 using the parameters: 5 min 95° C., (15 sec 95° C., 1 min 60° C.) 40 cycles. The relative amount of PDS2 ta-siRNA for each plant was normalized to miR166, calculated using Ct values.

TABLE 17

Relative amount of PDS2 ta-siRNA in TAS3/PDS2 transgenic plants carrying pRMW80.

| Phenotype | Transgenic event | Relative amount of PDS2 ta-siRNA |
|---|---|---|
| Pale Green | MW80-4 | 16.9 |
| Pale Green | MW80-7 | 6.8 |
| Pale Green | MW80-10 | 3.8 |
| Mainly Green | MW80-8 | 7.0 |
| Mainly Green | MW80-5 | 1.0 |
| Mainly Green | MW80-6 | 1.7 |

The result in Table 17 confirmed production of ta-siRNA/PDS in TAS3/PDS2 transgenic plants. Taken together, our data demonstrated that the engineering of miR390-directed ta-siRNA down-regulates expression of the gene-of-interest.

Example 7. Engineering Maize ta-siRNA Gene to Regulate Expression of DsRed2 Reporter Gene in Maize The entire maize ta-siRNA primary transcript or pre-ta-siRNA/miR390 (SEQ ID NO: 1 see Example 1) is synthesized with a BamHI site (GGATCC) and PstI site (CT-GCAG) at 5' and 3' end, respectively). To facilitate swapping a fragment containing engineered 21-nt phases, a XbaI site (TCTAGA) is created upstream of D8(+) phase by changing TCTGGT to TCTAGA. Pre-ta-siRNA/miR390 is released by BamHI and PstI digestion, and is subcloned into pRLM269 at BamHI-PstI sites which resulted in pRPR57 (SEQ ID NO: 44). pRPR57 has two recombination sites for subsequent Gateway multi-site cloning, attL1 site is close to BamHI site and attL2 site is close to PstI site.

Two swapping DNA fragments flanked by XbaI and PstI sites are synthesized. The $1^{st}$ fragment contains identical sequence between XbaI and Pst I in pRPR57 (SEQ ID NO: 44) except 5'D7(+) and 5'D8(+) sequences changed to 5'D7 (+) dsRed 2-2 (5'-ttgtagatgaagcagccgtcc 3'; SEQ ID NO: 45) and 5'D8(+) dsRed 2-2 (5' ttgtagatgaagcagccgtcc 3'; SEQ ID NO: 45). The XbaI-PstI fragment is replaced with XbaI-PstI fragment in pRPR57 (SEQ ID NO: 44), which results in pRPR58 (SEQ ID NO: 46). The $2^{nd}$ fragment contains identical sequence between XbaI and PstI in pRPR57 (SEQ ID NO: 44) except 5'D7(+) and 5'D8(+) sequence changed to 5'D7(+) dsRed 2-1 (5'-ttgaagcgcatgaactcggtg-3'; SEQ ID NO: 47) and 5'D8(+) dsRed 2-2 (5'-ttgtagatgaagcagccgtcc-3'; SEQ ID NO: 45). The XbaI-PstI fragment is replaced with XbaI-PstI fragment in pRPR57 (SEQ ID NO: 44), which results in pRPR59 (SEQ ID NO: 48). The XbaI-PstI fragment is swapped with XbaI-PstI fragment in pRPR57 (SEQ ID NO: 44), which results in pRPR59 (SEQ ID NO: 48). The engineered 5'D7(+) and 5'D8(+) in pRPR58 (SEQ ID NO: 46) target DsRed2 at position 342-362 bp, while engineered 5'D7(+) and 5'D8(+) in pRPR59 (SEQ ID NO: 48) target DsRed2 at position 26-44 bp and 342-362, respectively.

The binary expression vectors are constructed through multi-site Gateway cloning by combining three entry vectors and one destination vector in a LR reaction following a recommended protocol Invitrogen cat No. 52884). Quality of the final binary vectors is confirmed by restriction enzyme digestion, PCR, sequencing, or any appropriate molecular biological tools in the art. The entry and destination vectors used are:

pRLM283 (SEQ ID NO: 49) contains sugarcane bacilliform virus (ScBV) promoter flanked by two recombination sites attB4 and attB1.

pRLM336 (SEQ ID NO: 50) contains Glb1 promoter flanked by two recombination sites attB4 and attB1.

pRPR56 (SEQ ID NO: 51) contains rice chloroplast protein 12-like (Os.CP12) promoter plus the first intron from metallothionin gene, which is flanked by recombination sites attL4 and attR1.

pRLM293 (SEQ ID NO: 35) contains NOS terminator flanked by recombination sites attB2 and attB3.

pRLM217 (SEQ ID NO: 52) is a destination vector that contains the following components and flanked by recombination sites attL4 and attR1. Maize ubiquitin plus intron promoter, *E. coli* D-serine dehydratase [dsdA] as a selection marker and octopine synthase 3 terminator.

pRLM373 (SEQ ID NO: 53) is constructed through Gateway multi-site cloning of pRLM283, pRPR57, pRLM293 and pRLM217. The expression of pre-ta-siRNA is under control of ScBV promoter and NOS terminator. 5'D7(+) and 5'D8(+) ta-siRNAs target predicted endogenous gene encoding Auxin Response Factor (ARF4).

pRLM376 (SEQ ID NO: 54) is constructed through Gateway multi-site cloning of pRLM283, pRPR58, pRLM293 and pRLM217. The expression of pre-ta-siRNA is under control of ScBV promoter and NOS terminator. 5'D7(+) and 5'D8(+) ta-siRNAs target DsRed2 (BD Biosciences, cat# 632404) reporter gene (at position 341-362 bp).

pRLM379 (SEQ ID NO: 55) is constructed through Gateway multi-site cloning of pRLM283, pRPR59, pRLM293 and pRLM217. The expression of pre-ta-siRNA is under control of ScBV promoter and NOS terminator. 5'D7(+) and 5'D8(+) ta-siRNAs target DsRed2 reporter gene (at position 26-44 bp and 341-362 bp, respectively).

pRLM374 (SEQ ID NO: 56) is constructed through Gateway multi-site cloning of pRLM336, pRPR57, pRLM293 and pRLM217. The expression of pre-ta-siRNA is under control of maize (*Zea mays*; Zm) Glb1 promoter and NOS terminator. 5'D7(+) and 5'D8(+) ta-siRNAs target an endogenous gene encoding ARF4.

pRLM377 (SEQ ID NO: 57) is constructed through Gateway multi-site cloning of pRLM336, pRPR58, pRLM293 and pRLM217. The expression of pre-ta-siRNA is under control of maize Glb1 promoter and NOS terminator. The Glb1 promoter is only active in maize embryo. The engineered 5'D7(+) and 5'D8(+) ta-siRNAs target DsRed2 reporter gene (position 341-362 bp) in embryo.

pRLM380 (SEQ ID NO: 58) is constructed through Gateway multi-site cloning of pRLM336, pRPR59, pRLM293 and pRLM217. The expression of pre-ta-siRNA is under control of maize Globulin1 (Glb1) promoter and NOS terminator. The Glb1 promoter is only active in maize embryo. The engineered 5'D7(+) and 5'D8(+) ta-siRNAs target DsRed2 reporter gene (at position 26-44 bp and 341-362 bp, respectively) in embryo.

pRLM375 (SEQ ID NO: 59) is constructed through Gateway multi-site cloning of pRPR56, pRPR57, pRLM293 and pRLM217. The expression of pre-ta-siRNA is under control of Os.CP12 promoter with rice metallothionin (Os-.MET) intron1 and NOS terminator. 5'D7(+) and 5'D8(+) ta-siRNAs target endogenous gene encoding ARF4.

pRLM378 (SEQ ID NO: 60) is constructed through Gateway multi-site cloning of pBPSPRO56, pRPR58, pRLM293 and pRLM217. The expression of pre-ta-siRNA is under control of Os.CP12 promoter and NOS terminator. The Os.CP12 promoter is active only maize leaf. The engineered 5'D7(+) and 5'D8(+) ta-siRNAs target DsRed2 reporter gene (position 341-362 bp) in leaf.

pRLM381 (SEQ ID NO: 61) is constructed through Gateway multi-site cloning of pRPR56, pRPR59, pRLM293 and pRLM217. The expression of pre-ta-siRNA is under control of Os.CP12 promoter and NOS terminator. The Os.CP12 promoter is active only maize leaf. The engineered 5'D7(+) and 5'D8(+) ta-siRNAs target DsRed2 reporter gene (position 26-44 bp and 341-362 bp, respectively) in leaf.

All binary vectors were re-transformed into a transgenic homozygous maize line carrying RLM185 (SEQ ID NO:111), in which dsRed expression is under the control of the ScBV (sugarcane bacilliform virus) constitutive promoter.

To determine the effect of engineered ta-siRNAs on dsRed expression, leaf samples were collected from the selected transgenic events carrying one of the following sets of constructs: (1) RLM185 and RLM373, (2) RLM185 and RLM376, or (3) RLM185 and RLM379. RLM373 was used as a negative control. When dsRed fluorescence in leaf was examined using an image analysis instrument Typhoon 9400 (GE, Piscataway, N.J.), no significant reduction in dsRed expression was observed in the transgenic events containing ta-siRNA constructs. This result is consistent with miRNA profiling data that miR390 is not expressed in maize leaf. Therefore, ta-siRNA/dsRed was not able to be produced in order to down-regulate dsRed expression.

Example 8: Engineering Maize Ta-siRNA Gene to Regulate Expression of Maize Phytoene Desaturase Gene A similar strategy described in Example 5 is used to make binary expression vectors containing engineered ta-siRNAs targeting maize phytoene desaturase mRNA (Accession#L39266). For example, one swapping DNA fragment flanked by XbaI and PstI sites can be synthesized, pRPR34 (SEQ ID NO: 62). Two entry vectors for Gateway cloning were made. PRPR21 (SEQ ID NO:141) is identical to pRPR57 except both 5'D7 (+) and 5'D8 (+) phase sequences were replaced with PDS-3 (5'-TAGATAGAAACCTTCGATAGG-3'; SEQ ID NO: 63). PRPR22 (SEQ ID NO: 65) is identical to pRPR57 except that native 5'D7(+) sequence was changed to 5'D7(+) PDS-5 (5'-ttcacggcaaagcttgtatag-3'; SEQ ID NO: 64) and native 5'D8(+) sequence was changed to 5'D8(+) PDS-3 (5'-TAGATAGAAACCTTCGATAGG-3'; SEQ ID NO: 63). Ta-siRNA/PDS-5 targets maize PDS mRNA at position 147-167. Ta-siRNA/PDS-3 targets maize PDS mRNA at position 1585-1605.

PRLM423 (SEQ ID NO:142) was constructed through Gateway multi-site cloning of pRLM283, pRPR21, pRLM293 and pRLM217. The expression of pre-ta-siRNA was under the control of the ScBV promoter and NOS terminator. The 5'D7(+) and 5'D8(+) ta-siRNAs target maize phytoene desaturase.

PRLM424 (SEQ ID NO: 66) was constructed through Gateway multi-site cloning of pRLM283, pRPR22, pRLM293 and pRLM217. The expression of pre-ta-siRNA was under the control of the ScBV promoter and NOS terminator. 5'D7(+) and 5'D8(+) ta-siRNAs target maize phytoene desaturase.

PRLM427 (SEQ ID NO:143) was constructed through Gateway multi-site cloning of pRPR56, pRPR21, pRLM293 and pRLM217. The expression of pre-ta-siRNA was under the control of the Os.CP12 promoter and NOS terminator. 5'D7(+) and 5'D8(+) ta-siRNAs target maize phytoene desaturase in leaf.

PRLM428 (SEQ ID NO: 67) was constructed through Gateway multi-site cloning of pRPR56, pRPR22, pRLM293 and pRLM217. The expression of pre-ta-siRNA was under the control of the Os.CP12 promoter and NOS terminator. 5'D7(+) and 5'D8(+) ta-siRNAs target maize phytoene desaturase in leaf.

A series of plasmids was constructed identical to RPR57 except that each plasmid in the series contained a replacement of one of the maize (Zm) pre-ta-siRNA/miR390 phases (5'D2(+), 5'D3(+), 5'D4(+), 5'D5(+), 5'D6(+), 5'D7(+), or 5'D8(+)) with Zm PDS-3. Each phase replacement was generated by PCR using RPR57 as a template and then swapping the sequence between XbaI and KpnI or between HinDIII and KpnI in RPR57 with the like region of the PCR product (see Table 18).

TABEL 18

Entry vectors for Gateway cloning

| Construct name | Zm pre-ta-siRNa/miR390 phase replaced with sequence | Phase sequence replaced with | Region of RPR57 swapped with the respective PCR product |
|---|---|---|---|
| RJM128 (SEQ ID NO: 114) | 5'D2(+) (5'-ccagccttctgcatccaccta-3') | Zm PDS-3 (SEQ ID NO: 63) | XbaI-KpnI |
| RJM129 (SEQ ID NO: 115) | 5'D3(+) (5'-gtcccgatattgccgtgtttg-3') | Zm PDS-3 (SEQ ID NO: 63) | XbaI-KpnI |
| RJM130 (SEQ ID NO: 116) | 5'D4(+) (5'-ttcccactacatgcaggatca-3') | Zm PDS-3 (SEQ ID NO: 63) | XbaI-KpnI |

TABEL 18-continued

Entry vectors for Gateway cloning

| Construct name | Zm pre-ta-siRNa/miR390 phase replaced with sequence | Phase sequence replaced with | Region of RPR57 swapped with the respective PCR product |
|---|---|---|---|
| RJM131 (SEQ ID NO: 117) | 5'D5(+) (5'-tcgcatcccttgtttccttct-3') | Zm PDS-3 (SEQ ID NO: 63) | HinDIII-KpnI |
| RJM132 (SEQ ID NO: 118) | 5'D6(+) (5'-cactctgtgtctgcatccttc-3') | Zm PDS-3 (SEQ ID NO: 63) | XbaI-KpnI |
| RJM133 (SEQ ID NO: 119) | 5'D7(+) (5'-ttcttgaccttgtaaggctct-3') | Zm PDS-3 (SEQ ID NO: 63) | HinDIII-KpnI |
| RJM134 (SEQ ID NO: 120) | 5'D8(+) (5'-ttcttgaccttgtaaggcctc-3') | Zm PDS-3 (SEQ ID NO: 63) | XbaI-KpnI |

Binary expression vectors were made from RJM128, RJM129, RJM130, RJM131, RJM132, RJM133, and RJM134 by Gateway multi-site cloning.

RJM145 (SEQ ID NO: 126) was constructed through Gateway multi-site cloning of RLM283, RJM128, RLM293, and RLM217. The expression of pre-ta-siRNA is under the control of the ScBV promoter and NOS terminator. 5'D2(+) ta-siRNA targets the maize phytoene desaturase gene (position 1585-1605).

RJM146 (SEQ ID NO: 127) was constructed through Gateway multi-site cloning of RLM283, RJM129, RLM293, and RLM217. The expression of pre-ta-siRNA is under the control of the ScBV promoter and NOS terminator. 5'D3(+) ta-siRNA targets the maize phytoene desaturase gene (position 1585-1605).

RJM147 (SEQ ID NO: 128) was constructed through Gateway multi-site cloning of RLM283, RJM130, RLM293, and RLM217. The expression of pre-ta-siRNA is under the control of the ScBV promoter and NOS terminator. 5'D4(+) ta-siRNA targets the maize phytoene desaturase gene (position 1585-1605).

RJM148 (SEQ ID NO: 129) was constructed through Gateway multi-site cloning of RLM283, RJM131, RLM293, and RLM217. The expression of pre-ta-siRNA is under the control of the ScBV promoter and NOS terminator. 5'D5(+) ta-siRNA targets the maize phytoene desaturase gene (position 1585-1605).

RJM149 (SEQ ID NO: 130) was constructed through Gateway multi-site cloning of RLM283, RJM132, RLM293, and RLM217. The expression of pre-ta-siRNA is under the control of the ScBV promoter and NOS terminator. 5'D6(+) ta-siRNA targets the maize phytoene desaturase gene (position 1585-1605).

RJM150 (SEQ ID NO: 131) was constructed through Gateway multi-site cloning of RLM283, RJM133, RLM293, and RLM217. The expression of pre-ta-siRNA is under the control of the ScBV promoter and NOS terminator. 5'D7(+) ta-siRNA targets the maize phytoene desaturase gene (position 1585-1605).

RJM151 (SEQ ID NO: 132) was constructed through Gateway multi-site cloning of RLM283, RJM134, RLM293, and RLM217. The expression of pre-ta-siRNA is under the control of the ScBV promoter and NOS terminator. 5'D8(+) ta-siRNA targets the maize phytoene desaturase gene (position 1585-1605).

RJM137 (SEQ ID NO:133) was identical to RPR57 except the 147 bp 5'D2(+) through 5'D8(+) phases of Zm pre-ta-siRNA/miR390 (SEQ ID ???) were replaced with a 147 bp sequence from the maize phytoene desaturase coding sequence (SEQ ID ???). PCR was used to generate the 147 bp D2-D8 phase replacement using Zm PDS1 cDNA and RPR57 as templates. RJM137 was constructed by swapping the sequence between the XbaI and KpnI restriction sites in RPR57 with the like region of this PCR product.

The binary vector RJM154 (SEQ ID NO: 134) was constructed through Gateway multi-site cloning of RLM283, RJM137, RLM293, and RLM217. The expression of pre-ta-siRNA is under the control of the ScBV promoter and NOS terminator. 5'D2(+) through 5'D8(+) ta-siRNA targets the maize phytoene desaturase mRNA (position 1522-1668).

In order to express miR390 ubiquitously, maize (Zm) miR390 (5' aagctcaggagggatagcgcc 3'; SEQ ID NO:144) and miR390 star (5' ggcgctatctatcctgagctc 3'; SEQ ID NO:145) sequence were used to replace miR166 and miR166 star respectively in maize miR166 precursor (SEQ ID NO:146) via de novo synthesis and subsequent molecular cloning. pRCB10 (SEQ ID NO:147) was constructed through Gateway multi-site cloning, in which expression of the engineered Zm miR390 was under the control of the ScBV promoter and NOS terminator.

pRLM423 (SEQ ID NO:142) was transformed alone or together with RCB10 into wild-type maize. For co-transformation, *agrobacteria* transfected with RLM423 was mixed with *agrobacteria* transfected with RCB10 at 1:1 ratio, and final concentration of mixed *agrobacteria* was 1.0 at $OD_{600}$. pRLM423 has D-serine dehydratase (dsdA) as a selectable marker gene for maize transformation. RCB10 includes acetohydroxyacid synthase (AHAS) as a selectable marker gene. When calli were placed on selection media and subsequent regeneration media, putative transgenic calli carrying RLM423 failed to regenerate (see Table 19), while transgenic events carrying control vector RLM373 (i.e. no replacement of ta-siRNA) showed normal growth and regeneration.

TABLE 19

| Regeneration of RLM423 and RCB10 transgenic events | | | | | |
|---|---|---|---|---|---|
| Construct | Medium selection for dsdA[a] | Medium selection for dsdA and AHAS[b] | Medium selection for AHAS[c] | Number of callus capable of regeneration | Number of callus examined |
| RLM423 | Yes | | | None | ~100 |
| RLM423 and RCB10 | Yes | | | None | ~40 |
| RLM423 and RCB10 | | Yes | | None | ~125 |
| RLM423 and RCB10 | | | Yes | 30% | ~40 |

[a]D-serine at 10 mM (final concentraction),
[b]D-serine at 10 mM (final concentraction) and Pursuit at 500 nM (final concentration),
[c]Pursuit at 500 nM (final concentration)

The data indicate that miR390-directed ta-PDS siRNA production inhibits plant regeneration. This is contributed by endogenous miR390 because transgenic calli carrying RLM423 alone were unable to regenerate. MiR390 is predominantly expressed in maize embryogenic calli, which triggers ta-PDS siRNA production in transgenic calli containing RLM423. As a result, expression of PDS, an essential gene for plant regeneration in calli, was down-regulated. The important role of PDS in plant regeneration during transformation is further supported by experiments to down-regulate its expression using herbicide fluridone (1-methyl-3-phenyl-5-3-(trifluoromethyl)phenyl|-41H|-pyridinone). When wild-type calli were placed on the media containing such herbicide specifically targets PDS, regeneration rate decreases as herbicide concentration increase (0, 20 nM, 40 nM, 50 nM, 75 nM and 100 nM). At 75 nM and above, regeneration was completely inhibited.

Example 9. Engineering miR390 Target Site in Maize Ta-siRNA Primary Transcript This is to test miR390 binding site in maize ta-siRNA primary transcript is replaced by another miRNA complimentary site, the engineered ta-siRNA primary transcript is still capable to initiate ta-siRNAs to down-regulate expression of gene-of-interest.

A similar strategy described in Example 5 is used to make binary expression vectors. Two swapping DNA fragments flanked by XbaI and PstI sites are synthesized. The 1st fragment, pRPR35 (SEQ ID NO: 68), contains identical sequence between XbaI and PstI in pBPSPR057 (SEQ ID NO: 44) except D7(+) and D8(+) sequences changed to 5'D7(+) dsRed 2-2 5' ttgtagatgaagcagccgtcc 3' and 5'D8(+) dsRed 2-2 (5'-ttgtagatgaagcagccgtcc-3'; SEQ ID NO: 45 see Example 7) plus miR390 binding site 5' 3' changed to miR166 binding site (5'-GGGGAATGAAGCCTGGTCCGA-3'; SEQ ID NO: 69); complementary to Zm.miR166 5'TCGGACCAGGCTTCATTCCCC3'; SEQ ID NO: 70). The XbaI-PstI fragment is swapped with XbaI-PstI fragment in pBPSPRO57 (SEQ ID NO: 44 see Example 7), which results in pRPR36 (SEQ ID NO: 71). The 2nd fragment, pRPR37 (SEQ ID NO: 72), contains identical sequence to pRPR35, except miR390 binding site changed to miR167 binding site (5'-ACAGATCATGCTGGCAGCTTCA-3'; SEQ ID NO: 73), complementary to Zm.miR167 (5'-TGAAGCTGCCAGCATGATCTGT-3'; SEQ ID NO: 74). The XbaI-PstI fragment of pRPR37 (SEQ ID NO: 72) is swapped with XbaI-PstI fragment in pRPR57 (SEQ ID NO: 44), which results in pRPR38 (SEQ ID NO: 75).

pRPR39 (SEQ ID NO: 76) is constructed through Gateway multi-site cloning of pRPR283, pRPR36, pRPR293 and pRPR217. The expression of pre-ta-siRNA is under control of ScBV promoter and NOS terminator. Because Zm.miR166 precursor is only expressed in leaf and tassel, engineered 5'D7(+) and 5'D8(+) ta-siRNAs are generated in these tissue and target DsRed2 gene (at position 342-362) expression in leaf and tassel.

pRPR47 (SEQ ID NO: 77) is constructed through Gateway multi-site cloning of pRPR283, pRPR38, pRPR293 and pBPSLM217. The expression of pre-ta-siRNA is under control of ScBV promoter and NOS terminator. Because Zm.miR167 precursor is predominantly expressed in seeds, engineered 5'D7(+) and 5'D8(+) ta-siRNAs are generated in the seeds and target DsRed2 gene (at position 342-362) expression in seeds.

Many other tissues-specific miRNAs are listed in the following tables (Table 7, 8A, 8B, and 9) and in the literatures and databases (Zhang et al., (2005) Cell Research 15: 336-360) and two public websites (asrp.cgrb.oregonstate.edu/db/ and microrna.sanger.ac.uk/sequences/). During cloning and subsequent sequencing of miRNA, some miRNA-clones have shown different nucleotides at the ends (especially 3'-end), which are represented herein by small letters. The 3' end of miRNA is usually less important.

TABLE 20 miRNAs identified from *Arabidopsis thaliana* libraries.

| | | | At pri-miRNA ID | | | | |
|---|---|---|---|---|---|---|---|
| | | | At miR319b | At miR160b | At miR163 | At miR167a | At miR172b |
| At miRNA sequence | | | UUGGACUGAAGGGAGCUCCC | UGCCUGCUCCCUGUAUGCCA | UUGAAGAGGACUUGGAACUUCGAU | UGAAGCUGCCAGCAUGAUCUA | AGAAUCUUGAUGAUGCUGCAU |
| SEQ ID NO: | | | 88 | 84 | 85 | 86 | 87 |
| Hyseq clone ID | | | 65631003 | 65987305 | 65613288 | 64879045 | Contig1562 |
| Library Name | Library Synonym | Description | Relative Expression | Relative Expression | Relative Expression | Relative Expression | Relative Expression |
| AC103 | seedfill.n | Developing siliques with seeds 1 to 14 d post anthesis | 0 | 0 | 0 | 0.667 | 0 |

TABLE 20-continued miRNAs identified from *Arabidopsis thaliana* libraries.

| | | | At pri-miRNA ID | | | | |
|---|---|---|---|---|---|---|---|
| | | | At miR319b | At miR160b | At miR163 | At miR167a | At miR172b |
| AC104 | shoot.n | Normal rosettes prior to bolting | 0 | 0 | 0 | 0 | 0 |
| AC108 | shoot.path | Rosettes inoculated with conidia of *Erysiphe cichoracearum*, *Blumeria* f. sp. *Hordei*, *Alternaria alternata*, or *A. brassicicloa* for 12, 24, 48, 73 H | 0 | 0.059 | 0 | 0 | 0 |
| AC109 | flower.n | Normal flower bud and seed development | 0.333 | 0.235 | 0.714 | 0.333 | 0.778 |
| AC114 | stress.dsoc | Mixed treatment: 1. 2 H dessication, 2. up to 6 H 300 mM NaCl, 3. Cold at −2 C., or 0 C. or 6 C., 4. 20 mM hydrogen peroxide. (1, 2, 3) had some treatments allowing recovery. (1, 2) entire plants harvested, (3, 4) only shoots harvested. | 0 | 0.176 | 0.286 | 0 | 0 |
| AC115 | callus.n | Callus (Initiated from seeds) minimally induced to form either roots (5 mg/L NAA + 0.1 iP) or shoots (1 mg/L NAA + 0.1iP) | 0.667 | 0.176 | 0 | 0 | 0 |
| AC117 | root.mix | Roots from aerated hydroponics (continuous) with varying nutrient strength. | 0 | 0.353 | 0 | 0 | 0.111 |
| AC119 | Hb | Mixed mRNA from all *Arabidopsis libraris*. | 0 | 0 | 0 | 0 | 0.111 |

TABLE 21-A miRNAs identified from *Oryza sativa* libraries.

| | | | Os pri-miRNA ID | | | | | | | | | |
|---|---|---|---|---|---|---|---|---|---|---|---|---|
| | | | Os miR167g | Os miR168a | Os miR169g | Os miR169i | Os miR171b | Os miR397b | Os miR398a | Os miR399k | Os miR156l | Os miR159b |
| Os miRNA sequence | | | UGAAG CUGCC AGCAU GAUCUg | UCGCUU GGUGCA GAUCGG GAC | UAGCC AAGGA UGACU Ugccua | UAGCC AAGGA UGACU Ugccug | UGAUU GAGCC GUGCC AAUAUC | UUAUUG AGUGCA GCGUUG AUG | UGUGU UCUCA GGUCA CCCCUU | UGCC AAAG GAAA UUUG CCCCG | CGAC AGAA GAGA GUGA GCAUA | UUUGG AUUGA AGGGA GCUCUG |
| SEQ ID NO: | | | 97 | 98 | 99 | 100 | 101 | 102 | 103 | 104 | 90 | 91 |
| Hyseq clone ID | | | Contig6503 | Contig2277 | Contig17418 | 3282464 | 37697372 | Contig16437 | 37947875 | Contig10310 | 35003089 | Contig4124 |
| Library Name | Library Synonym | Description | Relative Expression | Relative Expression | Relative Expression | Relative Expression | Relative Expression | Relative Expression | Relative Expression | Relative Expression | Relative Expression | Relative Expression |
| AC003 | shoot.n | Shoots | 0.033 | 0.056 | 0.176 | 0.333 | 0 | 0.094 | 0 | 0.014 | 0 | 0.022 |
| AC004 | shoot.tip | Shoot meristems | 0 | 0.062 | 0.235 | 0 | 0 | 0.019 | 0 | 0.007 | 0.5 | 0.267 |
| AC005 | root.n | Roots | 0.067 | 0.025 | 0.118 | 0 | 0 | 0 | 0 | 0.007 | 0.5 | 0.022 |
| AC007 | Seedling.n | Seedling, shoots and roots | 0.033 | 0.056 | 0.059 | 0.333 | 0 | 0 | 0 | 0 | 0 | 0.089 |
| AC008 | flower.n | Flowers, male and female organs | 0.033 | 0.087 | 0.059 | 0 | 0 | 0.038 | 0 | 0.007 | 0 | 0.022 |
| AC009 | shoot.cold | Cold shoots (3, 6, 12, 24, 48) | 0.067 | 0.193 | 0.059 | 0 | 0 | 0.075 | 0 | 0.028 | 0 | 0 |
| AC010 | shoot.salt | Salt shoots (6, 12, 24, 48 H) | 0 | 0.118 | 0 | 0 | 0 | 0.094 | 0 | 0.007 | 0 | 0.022 |
| AC011 | shoot.dark | Shoots (2 + 8 H dark) | 0 | 0.056 | 0 | 0 | 0 | 0.075 | 0 | 0.056 | 0 | 0 |
| AC012 | root.salt | Salt roots (6, 12, 24, 48 H) | 0.133 | 0.006 | 0 | 0 | 0 | 0 | 0 | 0.007 | 0 | 0 |
| AC013 | seed.germ | Seedlings, seed and small shoot & root | 0.033 | 0.043 | 0 | 0 | 0 | 0 | 0 | 0.014 | 0 | 0.111 |
| AC014 | shoot.flood | Flooding shoots (5, 24, | 0.033 | 0.012 | 0 | 0 | 0.333 | 0.019 | 0 | 0.084 | 0 | 0 |

TABLE 21-A-continued

| | | | miRNAs identified from *Oryza sativa* libraries. Os pri-miRNA ID | | | | | | | | | |
|---|---|---|---|---|---|---|---|---|---|---|---|---|
| | | | Os miR167g | Os miR168a | Os miR169g | Os miR169i | Os miR171b | Os miR397b | Os miR398a | Os miR399k | Os miR156l | Os miR159b |
| | | 48, 72 + 24, 48 H) | | | | | | | | | | |
| AC015 | root.flood | Flooding roots (5, 24, 48 + 24, 48 H) | 0.033 | 0.025 | 0 | 0 | 0.333 | 0.019 | 0.083 | 0.007 | 0 | 0 |
| AC016 | shoot.drou | Drought shoots (24, 48 + 6, 12 H) | 0.133 | 0.031 | 0.059 | 0 | 0 | 0.019 | 0.417 | 0.308 | 0 | 0.044 |
| AC018 | root.drou | Drought roots (24, 48 + 6, 12 H) | 0 | 0.043 | 0 | 0.333 | 0 | 0.019 | 0.083 | 0 | 0 | 0.022 |
| AC019 | panicle.n | Panicles (pooled over 20 days) | 0 | 0.043 | 0 | 0 | 0.333 | 0 | 0 | 0 | 0 | 0.267 |
| AC020 | embryo.n | Immature embryos and endosperm | 0 | 0 | 0 | 0 | 0 | 0 | 0 | 0 | 0 | 0 |
| AC021 | shoot.in | Nipponbare biotic stress 1 | 0 | 0.037 | 0 | 0 | 0 | 0.094 | 0 | 0.098 | 0 | 0 |
| AC022 | Flower.heat | Head flowers (1-5, 10 15 Days) | 0.1 | 0.012 | 0 | 0 | 0 | 0 | 0 | 0 | 0 | 0.022 |
| AC024 | shoot.cyp | Cypress shoots | 0.133 | 0.012 | 0.118 | 0 | 0 | 0.075 | 0 | 0.014 | 0 | 0 |
| AC025 | shoot.bact | Nipponbare biotic stress 3 | 0.033 | 0.019 | 0.059 | 0 | 0 | 0.283 | 0.417 | 0.049 | 0 | 0.067 |
| AC026 | shoot.fung | Nopponbare biotic stress 2 | 0.1 | 0.037 | 0.059 | 0 | 0 | 0.038 | 0 | 0.042 | 0 | 0 |
| AC027 | Flower.cyp | Cypress flowers | 0.033 | 0.012 | 0 | 0 | 0 | 0.038 | 0 | 0.021 | 0 | 0.022 |
| AC092 | hb | Combined mRNA long clone library | 0 | 0.012 | 0 | 0 | 0 | 0 | 0 | 0.231 | 0 | 0 |

TABLE 21-B (cont. from table 21-A) miRNAs identified from *Oryza sativa* libraries.

| | | | Os pri-miRNA ID | | | | | |
|---|---|---|---|---|---|---|---|---|
| | | | Os 156a | Os miR160f | Os miR162a | Os miR164a | Os miR164d | Os miR166a |
| Os miRNA sequence | | | UGACAGAAG AGAGUGAGC ACA | UGCCUGGCU CCCUGAAUGC CA | UCGAUAAAC CUCUGCAU CCAG | UGGAGAAG CAGGGCAC GUGCA | UGGAGAA GCAGGGC ACGUGCU | UCGGAC CAGGCU UCAUUCC CC |
| SEQ ID NO: | | | 89 | 92 | 93 | 94 | 95 | 96 |
| Hyseq clone ID | | | 35003089 | 35420108 | 39760468 | 34256080 | 34832815 | 35093513 |
| Library Name | Library Synonym | Description | Relative Expression | Relative Expression | Relative Expression | Relative Expression | Relative Expression | Relative Expression |
| AC003 | shoot.n | Shoots | 0 | 0 | 0 | 0 | 0 | 0 |
| AC004 | shoot.tip | Shoot meristems | 0.5 | 0 | 0.158 | 0.286 | 0 | 0.069 |
| AC005 | root.n | Roots | 0.5 | 0 | 0.158 | 0.143 | 0.333 | 0.241 |
| AC007 | seedling.n | Seedling, shoots and roots | 0 | 0 | 0 | 0 | 0 | 0 |
| AC008 | flower.n | Flowers, male and female organs | 0 | 0.25 | 0.053 | 0 | 0 | 0 |
| AC009 | shoot.cold | Cold shoots (3, 6, 12, 24, 48) | 0 | 0 | 0 | 0 | 0.333 | 0 |
| AC010 | shoot.salt | Salt shoots (6, 12, 24, 48 H) | 0 | 0 | 0 | 0 | 0 | 0 |
| AC011 | shoot.dark | Shoots (2 + 8 H dark) | 0 | 0 | 0 | 0 | 0 | 0 |
| AC012 | root.salt | Salt roots (6, 12, 24, 48 H) | 0 | 0 | 0 | 0.143 | 0 | 0.034 |
| AC013 | seed.germ | Seedlings, seed and small shoot & root | 0 | 0 | 0.105 | 0 | 0 | 0.241 |
| AC014 | shoot.flood | Flooding shoots (5, 24, 48, 72 + 24, 48 H) | 0 | 0 | 0.053 | 0 | 0 | 0 |
| AC015 | root.flood | Flooding roots (5, 24, 48 + 24, 48 H) | 0 | 0 | 0 | 0 | 0 | 0.069 |
| AC016 | shoot.drou | Drought shoots (24, 48 + 6, 12 H) | 0 | 0 | 0.053 | 0 | 0 | 0.138 |
| AC018 | root.drou | Drought roots (24, 48 + 6, 12 H) | 0 | 0 | 0 | 0 | 0 | 0 |
| AC019 | panicle.n | Panicles (pooled over 20 days) | 0 | 0 | 0.263 | 0.286 | 0 | 0.103 |
| AC020 | embryo.n | Immature embryos and endosperm | 0 | 0 | 0 | 0.143 | 0 | 0 |
| AC021 | shoot.in | Nipponbare biotic stress 1 | 0 | 0 | 0 | 0 | 0 | 0 |
| AC022 | flower.heat | Head flowers (1-5, 10 15 Days) | 0 | 0.125 | 0 | 0 | 0 | 0.034 |
| AC024 | shoot.cyp | Cypress shoots | 0 | 0 | 0 | 0 | 0 | 0.034 |
| AC025 | shoot.bact | Nipponbare biotic stress 3 | 0 | 0 | 0.053 | 0 | 0 | 0.034 |

TABLE 21-B-continued

| (cont. from table 21-A) miRNAs identified from *Oryza sativa* libraries. | | | Os pri-miRNA ID | | | | | |
|---|---|---|---|---|---|---|---|---|
| | | | Os 156a | Os miR160f | Os miR162a | Os miR164a | Os miR164d | Os miR166a |
| AC026 | shoot.fung | Nopponbare biotic stress 2 | 0 | 0 | 0.053 | 0 | 0 | 0 |
| AC027 | flower.cyp | Cypress flowers | 0 | 0.625 | 0 | 0 | 0.333 | 0 |
| AC092 | hb | Combined mRNA long clone library | 0 | 0 | 0.053 | 0 | 0 | 0 |

TABLE 22 miRNAs identified from *Zea mays* libraries.

| Zm pri-miRNA ID | | | Zm miR156 | Zm miR159 | Zm miR160b | Zm miR166 | Zm miR167 | Zm miR171 |
|---|---|---|---|---|---|---|---|---|
| ZmmiRNA sequence | | | UGACAGAAGAGAGUGAGCAC | UUUGGAUUGAAGGGAGCUCUA | UGCCUGGCUCCCUGUAUGCCA | UCGGACCAGGCUUCAUUCCCC | UGAAGCUGCCAGCAUGAUCUGG | UGAUUGAGCCGCGCCAAUAUC |
| SEQ ID NO: | | | 105 | 106 | 107 | 108 | 109 | 110 |
| Hyseq clone ID | | | 58989601 | 62202898 | 65442307 | 57507158 | 62178918 | 61430017 |
| Library Name | Library Synonym | Description | Relative Expression | Relative Expression | Relative Expression | Relative Expression | Relative Expression | Relative Expression |
| AC073 | stem.n | underground stem with meristem | 0.015 | 0.176 | 0.056 | 0 | 0 | 0 |
| AC079 | tassel.n | root only from young to mid-age plant | 0 | 0 | 0 | 0.25 | 0 | 0 |
| AC080 | ear.r1 | Tassel development | 0 | 0 | 0 | 0 | 0 | 0 |
| AC081 | seed.r3 | Ear development | 0 | 0 | 0 | 0 | 0 | 0 |
| AC082 | lvs.prefl | Leaves of mixed ages, all prior to seed-fill | 0.123 | 0 | 0 | 0.25 | 0 | 0 |
| AC083 | ear.imm | upper leaves near ear before and during seed-fill | 0.031 | 0.059 | 0 | 0 | 0 | 0 |
| AC084 | seed.germ | Stem tissue near ear at tassel emergence and during seed-fill | 0 | 0 | 0 | 0 | 0 | 0 |
| AC085 | lvs.seedfill | Fertilized ovules/young kernels | 0.015 | 0 | 0 | 0.5 | 0 | 0 |
| AC086 | seed.r4 | Kernel at milk stage | 0 | 0 | 0 | 0 | 0.32 | 0 |
| AC087 | seed.b73 | Kernel at early dough stage | 0 | 0 | 0 | 0 | 0 | 0 |
| AC089 | root.n | Germinating seed from radicle emergence until the first leaf | 0.062 | 0 | 0 | 0 | 0 | 0 |

TABLE 22-continued miRNAs identified from Zea mays libraries.

| Zm pri-miRNA ID | | | Zm miR156 | Zm miR159 | Zm miR160b | Zm miR166 | Zm miR167 | Zm miR171 |
|---|---|---|---|---|---|---|---|---|
| AC088 | stem.ear | Kernel at 9 and 19 d post pollination | 0.077 | 0.059 | 0 | 0 | 0 | 0 |
| AC093 | stem.cold | Shoot cold, 10 d in chamber at 10 C./4 C. | 0.062 | 0.471 | 0.056 | 0 | 0 | 0.2 |
| AC094 | seed.r2 | Very young kernels at blister stage | 0 | 0 | 0 | 0 | 0.32 | 0 |
| AC096 | seed.mo17 | Kernels at early dent stage | 0 | 0 | 0.056 | 0 | 0.16 | 0.2 |
| AC095 | seed.r5 | Kernels at 10 and 21 s post pollination | 0 | 0 | 0 | 0 | 0.08 | 0 |
| AC099 | hb | Combined mRNA long clone library | 0.031 | 0.235 | 0 | 0 | 0.08 | 0 |
| AC105 | callus.agro | Callus from immature embros, infected with agro-bacteriurm | 0.031 | 0 | 0 | 0 | 0 | 0 |
| AC107 | callus.n | Normal callus from immature embryos at 7, 14, 31, 44, 65 d after cultivation | 0.108 | 0 | 0.444 | 0 | 0 | 0 |
| AC113 | shoot.drou | 3 sets: 1. Shoot, no water at V4 for 3, 7, 10 d +− 6 h recovery; 2. Shoot + root, dried 3, 6, 24 h +− 6 h water; 3. Shoot, no water at v15 for 6, 9, 13, 16 d +/− 6 h water | 0.246 | 0 | 0.111 | 0 | 0.04 | 0 |
| AC118 | root.drou | 2 sets: 1. Root, no water at V4 for 3, 7, 10 d +/− 6 h recovery; 2. root, air-dried 3, 6, 24 h +/− 6 h rewater. | 0 | 0 | 0.167 | 0 | 0 | 0 |
| AC120 | root.lown | Roots only | 0.169 | 0 | 0.111 | 0 | 0 | 0.2 |
| AC121 | shoot.lown | Shoot only | 0.031 | 0 | 0 | 0 | 0 | 0.4 |

The downstream miR390 binding site (5'-CCTTCTATCCCTCCTGAGCTA-3') in ta-siRNA primary transcript was replaced with maize endogenous miRNA binding sites for miR156, miR159, miR166 and miR172 (Table 23). Instead targeting dsRed reporter gene, maize (Zm) pre-ta-siRNA/miR390 with an alternative miRNA binding site was modified, so that native 5'D7(+) and 5'D8 (+) ta-siRNAs were replaced with engineered ta-siRNAs targeting maize endogenous phytoene desaturase (PDS).

TABLE 23

| Maize miRNA binding site in the target gene | | | |
|---|---|---|---|
| miRNA | | Genbank accession # of maize mRNA | Location of binding site within maize |
| binding site | miRNA binding site sequence | containing miRNA binding site | endogenous mRNA |
| miR156 | 5'-GTGCTCTCTCTCTTCTGTCAA-3' (SEQ ID NO: 148) | AJ011619 | 559-579 |
| miR159 | 5'-TGGAGCTCCCTTCACTCCAAG-3' ((SEQ ID NO: 149) | CN844582 | 601-621 |
| miR166 | 5'-CTGGGATGAAGCCTGGTCCGG-3' ((SEQ ID NO: 150) | AY501430 | 635-655 |
| miR172 | 5'-CTGCAGCATCATCAGGATTCC-3' ((SEQ ID NO: 151) | AY714877 | 4258-4278 |

Plasmids were constructed identical to RPR57 except that each plasmid in the series contained a replacement of the downstream miR390 binding site with either a miR156, miR159, miR166, or miR172 binding site and replacement of the 5'D8(+) phase with Zm PDS-3 (SEQ ID NO:63) and the 5'D7(+) phase with either Zm PDS-3 or Zm PDS-5 (SEQ ID NO:64). Each phase replacement was generated by PCR using either RLM423 or RLM424 as a template and then swapping the sequence between XbaI and KpnI of RPR57 with the like region of the PCR product (Table 24).

TABLE 24

| Entry vectors for Gateway cloning | | | |
|---|---|---|---|
| Construct name | PCR template used in construction | miRNA binding site that replaces miR390 binding site | 5'D7(+) and 5'D8(+) phase replacements |
| RJM135 ((SEQ ID NO: 121) | RLM423 | miR172 | 5'D7(+) = Zm PDS-3<br>5'D8(+) = Zm PDS-3 |
| RJM136 ((SEQ ID NO: 122) | RLM424 | miR172 | 5'D7(+) = Zm PDS-5<br>5'D8(+) = Zm PDS-3 |
| RJM140 ((SEQ ID NO: 123) | RLM423 | miR156 | 5'D7(+) = Zm PDS-3<br>5'D8(+) = Zm PDS-3 |
| RJM141 ((SEQ ID NO: 124) | RLM423 | miR159 | 5'D7(+) = Zm PDS-3<br>5'D8(+) = Zm PDS-3 |
| RJM142 ((SEQ ID NO: 125) | RLM423 | miR166 | 5'D7(+) = Zm PDS-3<br>5'D8(+) = Zm PDS-3 |

Binary expression vectors were made from RJM135, RJM136, RJM140, RJM141, and RJM142 by Gateway multi-site cloning.

RJM152 (SEQ ID NO: 213) was constructed through Gateway multi-site cloning of RLM283, RJM135, RLM293, and RLM217. The expression of pre-ta-siRNA is under the control of the ScBV promoter and NOS terminator. 5'D7(+) and 5'D8(+) ta-siRNAs target the maize phytoene desaturase gene (position 1585-1605).

RJM153 (SEQ ID NO: 135) was constructed through Gateway multi-site cloning of RLM283, RJM136, RLM293, and RLM217. The expression of pre-ta-siRNA is under the control of the ScBV promoter and NOS terminator. 5'D7(+) and 5'D8(+) ta-siRNAs target the maize phytoene desaturase gene (positions 1585-1605 and ???-???).

RJM156 (SEQ ID NO: 136) was constructed through Gateway multi-site cloning of RLM283, RJM140, RLM293, and RLM217. The expression of pre-ta-siRNA is under the control of the ScBV promoter and NOS terminator. 5'D7(+) and 5'D8(+) ta-siRNAs target the maize phytoene desaturase gene (positions 1585-1605).

RJM157 (SEQ ID NO: 137) was constructed through Gateway multi-site cloning of RLM283, RJM141, RLM293, and RLM217. The expression of pre-ta-siRNA is under the control of the ScBV promoter and NOS terminator. 5'D7(+) and 5'D8(+) ta-siRNAs target the maize phytoene desaturase gene (positions 1585-1605).

RJM158 (SEQ ID NO: 138) was constructed through Gateway multi-site cloning of RLM283, RJM142, RLM293, and RLM217. The expression of pre-ta-siRNA is under the control of the ScBV promoter and NOS terminator. 5'D7(+) and 5'D8(+) ta-siRNAs target the maize phytoene desaturase gene (positions 1585-1605).

RJM160 (SEQ ID NO: 139) was constructed through Gateway multi-site cloning of RLM283, RJM140, RLM293, and RLM218. The expression of pre-ta-siRNA is under the control of the ScBV promoter and NOS terminator. 5'D7(+) and 5'D8(+) ta-siRNAs target the maize phytoene desaturase gene (positions 1585-1605).

Example 10: miR173 and miR390 Profiling in *Arabidopsis* and Maize

DNA sequences encode miR390 was identified through data mining from different plant species including *Arabidopsis thaliana* (SED ID NO: 215-216), *Populus* balsamifera (SEQ ID NO: 217-220), *Oryza sativa* (SED ID NO:221), *Brassica rapa* (SEQ ID NO:222), *Medicago truncatula* (SEQ ID NO:223) and *Zea mays* (SEQ ID NO:210). Maize miR390 precursor was identified from an internal maize transcriptome database through DNA sequence homology search. It is 1,119 bp in-length and polyadenylated at the 3' end of the precursor. Expression patterns of maize miR390 precursor were characterized using a technique of sequencing by hybridization so called Hyseq-technology. The result indicates that miR390 precursor is predominantly expressed in callus and medium level of expression in kernels (Table 25).

TABLE 25

| Expression pattern of maize miR390 precursor | | | |
|---|---|---|---|
| Library Name | Library Synonym | Normalized Clone Distribution | Relative Expression |
| AC073 | stem | 0 | 0 |
| AC079 | tassel | 0 | 0 |
| AC080 | ear R1 | 0 | 0 |
| AC081 | kernel R3 | 0 | 0 |
| AC082 | leaves preflower | 0 | 0 |
| AC083 | immature ear | 0 | 0 |
| AC084 | kernel germ | 0 | 0 |
| AC085 | leaves kernel fill | 0 | 0 |
| AC086 | kernel R4 | 1 | 0.0910 |
| AC087 | kernel b73 | 1 | 0.0910 |
| AC089 | root | 0 | 0 |
| AC088 | stem at ear stage | 0 | 0 |
| AC093 | stem.cold | 0 | 0 |
| AC094 | kernel R2 | 0 | 0 |
| AC096 | kernel.mo17 | 0 | 0 |
| AC095 | kernel R5 | 0 | 0 |
| AC105 | callus agro | 2 | 0.1820 |
| AC107 | callus | 5 | 0.4550 |
| AC113 | shoot drought | 1 | 0.0910 |
| AC118 | root drought | 0 | 0 |
| AC120 | root low nitrogen | 0 | 0 |
| AC121 | shoot low nitrogen | 0 | 0 |

MiR390 profiling was conducted by using the technique and protocol developed by Applied Biosystems (Chen et al., 2005 Nucleic Acids Research 33:e179). In brief, 5 ng of total RNA was used in 15 □L of reverse transcription (RT) reaction containing a miRNA specific stem-loop RT primer and multiScribe reverse transcriptase (Applied Biosystems, P/N: 4319983) under the conditions of 16° C. 30 min, 42° C. 30 min, and 85° C. 5 min. Following RT reaction, PCR was conducted using miRNA specific primers and probe under cycling condition of 95° C. 10 min, 95° C. 15 seconds, 60° C. 60 seconds for 40 cycles. Total RNA extracts from a total of 13 different maize tissues or stages were analyzed. Maize glyceraldehyde-3-phosphate dehydrogenase (GADPH) subunit C was used as an internal control to normalize miRNA expression among different tissue samples. The result indicates that the highest expression of miR390 was detected in embryogenic calli followed by kernels (R3 and R4 stages) and embryo, in order. MiR390 is nearly undetectable in leaf. Expression patterns from both miR390 precursor and mature form were almost identical to each other (Table 25 and 26).

TABLE 26

| miR390 profiling in maize | | | | |
|---|---|---|---|---|
| RNA library code and tissue | Rep1 | Rep2 | Average | StDev |
| AC89 (Root) | 17.86 | 22.16 | 20.01 | 3.04 |
| AC79 (Tassel) | 38.80 | 36.60 | 37.70 | 1.56 |
| AC94 (Kernel R2 stage) | 0.03 | 0.02 | 0.03 | 0.01 |
| AC81 (Kernel R3 stage) | 399.31 | 360.76 | 380.04 | 27.25 |
| AC86 (kernel R4 stage) | 290.64 | 253.90 | 272.27 | 25.98 |
| AC95 (Kernel R5 stage) | 7.36 | 9.50 | 8.43 | 1.51 |
| AC80 (Ear) | 0.29 | 0.31 | 0.30 | 0.02 |
| AC82 (lower leaves) | 1.56 | 1.45 | 1.51 | 0.08 |
| AC85 (Upper leaves) | 0.37 | 0.32 | 0.34 | 0.04 |
| AC118 (root, drought conditions) | 1.16 | 1.19 | 1.18 | 0.02 |
| Embryo | 76.70 | 78.46 | 77.58 | 1.24 |
| Type I Callus | 1033.15 | 655.39 | 844.27 | 267.11 |
| Type II Callus | 499.83 | 369.01 | 434.42 | 92.51 |

The method and protocol described above were also used to profile miR173 and miR390 expression level in different types of *Arabidopsis* tissue, including leaves, roots, stems, flowers and siliques. Ten-day old *Arabidopsis* seedlings were also included in the experiment. As described in Example 5, Actin 2 was used as the endogenous control. The results in Table 27 and Table 28 indicate that both miR173 and miR390 are most abundant in siliques. The second highest level of expression was detected in flowers. They remain a low level in vegetative tissues with a relatively higher level for miR173 than miR390.

TABLE 27

| miR173 profiling in *Arabidopsis* tissues (normalized against *Arabidopsis* Actin 2). | | | | |
|---|---|---|---|---|
| Tissue | Rep1 | Rep2 | Average | Standard Deriviation |
| Leaf | 243.80 | 248.03 | 245.91 | 3.00 |
| Stem | 48.98 | 49.52 | 49.25 | 0.38 |
| Root | 263.48 | 234.43 | 248.96 | 20.54 |
| Flower | 334.10 | 293.93 | 314.01 | 28.41 |
| Silique | 53679.24 | 49684.78 | 51682.01 | 2824.50 |
| Seedling | 138.02 | 115.02 | 126.52 | 16.27 |

TABLE 28

| miR390 profiling in *Arabidopsis* tissues (normalized against *Arabidopsis* Actin 2). | | | | |
|---|---|---|---|---|
| Tissue | Rep1 | Rep2 | Average | Standard Deriviation |
| Leaf | 101.59 | 97.79 | 99.69 | 2.68 |
| Stem | 13.99 | 12.99 | 13.49 | 0.70 |
| Root | 33.43 | 23.60 | 28.52 | 6.95 |
| Flower | 193.66 | 160.56 | 177.11 | 23.40 |
| Silique | 6201.22 | 49684.78 | 51682.01 | 2824.50 |
| Seedling | 138.02 | 5374.39 | 5787.80 | 584.66 |

Example 11. Tissue-Specific Down-Regulation of Endogenous PDS Gene Expression by Engineered TAS1 in *Arabidopsis*

To investigate whether engineered ta-siRNA can down-regulate gene expression in a tissue-specific manner, we used a leaf-preferred promoter UK398 (Example 3) to drive the expression of TAS1/PDS gene in *Arabidopsis*. The UK398 promoter was isolated from *Arabidopsis*. GUS gene expression analysis using this promoter indicated that it had strong and ubiquitous expression in leaves, but also weak expression in some parts of flowers such as sepals and carpels. Total RNA from leaves and flowers of T1 plants were extracted and the PDS level was analyzed using the same Q-RT-PCR procedure described in Example 5. Actin 2 was used as an endogenous control. As shown in Table 29, the endogenous PDS level in the transgenic leaves was reduced compared with wild-type plants, while it remained approximately the wild-type level in flowers. This result indicates that the engineered TAS1/PDS driven by the leaf-preferred promoter could down-regulate endogenous PDS gene preferably in leaves but not in flowers.

TABLE 29

Tissue-specific down regulation of endogenous PDS expression by engineered TAS1/PDS2(#61 plants).

| RNA sample | Rep 1 | Rep 2 | Average | Standard Derivation |
|---|---|---|---|---|
| #61-1 Leaf | 0.70 | 0.50 | 0.60 | 0.14 |
| #61-2 Leaf | 0.10 | 0.07 | 0.08 | 0.02 |
| #61-3 Leaf | 0.07 | 0.05 | 0.06 | 0.01 |
| Col-0 Leaf | 0.45 | 0.37 | 0.41 | 0.05 |
| Col-0 Leaf | 0.45 | 0.23 | 0.34 | 0.16 |
| #61-1 Flower | 0.57 | 0.52 | 0.54 | 0.04 |
| #61-2 Flower | 0.58 | 0.58 | 0.58 | 0.00 |
| #63-1 Flower | 0.50 | 0.33 | 0.42 | 0.12 |
| Col-0 Flower | 0.62 | 0.51 | 0.56 | 0.07 |
| Col-0 Flower | 0.54 | 0.25 | 0.40 | 0.20 |

A real-time PCR method (Example 6) was used for PDS2 ta-siRNA detection in leaf and flower tissue from plants #61-1, #61-2, and #61-3. Total RNA was DNase treated, a poly(A) tail added, and the poly(A) tailed RNA reverse transcribed as in (Example 6). Real-time PCR for PDS2 ta-siRNA detection was carried out as in Example 6 except forward primers MW-P94 (5'-ATTCATTCCT-GAAGAAACCGG-3') (SEQ ID NO: 204) and MW-P99 (GAAAGTGACTACATCGGGGAA) (SEQ ID NO: 202) (Example 5) were used. The 3' most 16 nucleotides of MW-P94 are identical to bases 1-16 of the PDS2 21 nt ta-siRNA and MW-P99 is identical to *Arabidopsis* miR166 and used as a positive control for the assay. PDS2 ta-siRNA could be detected in leaf and flower tissue from plants 61-2 and 61-3, but not in the leaf or tissue of plant 61-1. PDS2 ta-siRNA detection was confirmed by running 8 □L of the 61-2-leaf and flower real-time PCR products on a 15% acrylamide gel, EtBr staining and observing a PCR product of the correct size. The intensity of the PDS2 ta-siRNA PCR product from flower was approximately 20% that of the leaf PCR product as judged by EtBr staining. This suggested that production of PDS2-ta-siRNA is much lower in the flower than in the leaf, therefore, no significant reduction of PDS mRNA in flower. The detection of low amount of PDS2 ta-siRNA in flowers is consistent with the weak activity of the UK398 promoter in flowers.

dsRNA-derived siRNA often causes systemic gene silencing, however, these results suggested that engineered ta-siRNA down-regulated its target gene expression only in the tissue that ta-siRNA is expressed at high level.

The following names of constructs in one row oth the table are interchangeable and relate to the same sequences:

| | |
|---|---|
| pRMW001 | pRMW1 |
| pRMW002 | pRMW2 |
| pRMW003 | pRMW3 |
| pRMW004 | pRMW4 |
| pRMW005 | pRMW5 |
| pRMW006 | pRMW6 |
| pRMW007 | pRMW7 |
| pRMW008 | pRMW8 |
| pRMW009 | pRMW9 |
| pRMW013 | pRMW13 |
| pRMW014 | pRMW14 |
| pRMW015 | pRMW15 |
| pRMW016 | pRMW16 |
| pRMW023 | pRMW23 |
| pRMW024 | pRMW24 |
| pRMW025 | pRSM5 |
| pRMW026 | pRSM6 |
| pRPR31 | pRLM424 |
| pRPR32 | pRLM428 |
| pRPR40 | pRPR47 |

SEQUENCE LISTING (223 sequences)

SEQ ID NO: 1 - DNA, 869 bp, Zea mays
  misc_feature (541)..(561): 5' D8 (+) phase
  misc_feature (562)..(582): 5' D7 (+) phase
  misc_feature (583)..(603): 5' D6 (+) phase
  misc_feature (604)..(624): 5' D5 (+) phase
  misc_feature (625)..(645): 5' D4 (+) phase
  misc_feature (646)..(666): 5' D3 (+) phase
  misc_feature (667)..(687): 5' D2 (+) phase
  misc_feature (688)..(708): 5' D1 (+) phase
  misc_binding (698)..(718): binding site of miR390
  misc_feature (708)..(708): initiation site of ta-siRNA
ccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctggtttctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatcca

SEQ ID NO: 2 - DNA, 697 bp, Triticum aestivum
  misc_feature (501)..(521): 5' D5 (+) phase
  misc_feature (522)..(542): 5' D4 (+) phase
  misc_feature (543)..(563): 5' D3 (+) phase
  misc_feature (564)..(584): 5' D2 (+) phase
  misc_feature (585)..(605): 5' D1 (+) phase
  misc_binding (594)..(615): miR390 binding site
  misc_feature (605)..(605): ta-siRNA initiation site
gccttctgtaccactagtagtggtactactacatctccgaagatctacagagatcttcatccccaactcggcggcagtgattgtttccaagatggccagtgatgaggattcactagatgatcaaaaccctagatcttggaccgttagcaacactagtgctgtgagttaatgctacctttactttcagaaaggaaagagtgtaccatgcacctaccgttttgatgttactatgtattctttttattttgatttctcagattaacaagacagaagaagcatccagcacggtccaggatcatcacccacaaaaagcagtagtgaacttcttaaaggatgagaataccaccaaaacgatccatgagcaatggcaagcaaaagctaaggttgcgtcgtagcctataagccggtgttatcccgactgagctttctattatccctaaactctcccatatgcctatagttaaatcattttctggccactcctcatgccagaattaatgttcttgaccttgtaaggccttttcttgaccttgtaaggccctccccttacgtttctcgtgccgccgggtgtctccaacctcacactttctccccccttctatccctcctgagctatctccatgcatattttgtctagcaatctagatgagacatgagagatgatattggaataaaagtctgtggtaaattaaatttt

SEQ ID NO: 3 - DNA, 615 bp, Oryza sativa
  variation (1)..(615): "n" in the sequence meaning A or T or C or G
  misc_feature (196)..(196): n is a, c, g, or t
  misc_feature (399)..(419): 5' D7 (+) phase
  misc_feature (420)..(440): 5' D6 (+) phase
  misc_feature (441)..(461): 5' D5 (+) phase
  misc_feature (462)..(482): 5' D4 (+) phase
  misc_feature (483)..(503): 5' D3 (+) phase
  misc_feature (504)..(524): 5' D2 (+) phase
  misc_feature (525)..(546): 5' D1 (+) phase
  misc_binding (536)..(556): Binding site of miR390
  misc_feature (546)..(546): Initiation site of ta-siRNA
cctcgctcacctttttctcttgcctgagccaagagctacactttctatatccaccacttcaccgtgcaaaccccatgcacacgccttgacagaagctgagctagcttctcctgcgtcgctgcaagtgctactttggttcgtgactgaaagccaaatggaagatacggatcaggagctatgcaccgttgcggtggangatgatgagttcaggaaaactcaagccatgtagacacttgttgttctatcaagactcccttcaccgagaagcatccataaaaatggttcatgtttagcaatagcacggtgttatcctaactgagcttttcttctagccaccgtccacatccttcttcaaaacctcaacatcactttgtgtggggaattaaaaggaattggtcttcttgaccttgcaagaccttttcttgaccttgtaagacccaacatcgttgtgttgtttttcttgtttcttatttttcaatttcatccacctcttctttctacctcccatctttctcctagttcttgccttctctctcggtctatccctcctgagctgtattgatcactttctatgttattttctcgatgtttaaaagaaaattaattttgtttagc

SEQ ID NO: 4 - DNA, 762 bp, Gossypium
  misc_feature (444)..(464): D8
  misc_feature (465)..(485): D7
  misc_feature (486)..(506): D6
  misc_feature (507)..(527): D5
  misc_feature (528)..(548): D4
  misc_feature (549)..(569): D3
  misc_feature (570)..(590): D2
  misc_feature (591)..(612): D1
  misc_binding (601)..(622): binding sitemiR390
  misc_feature (613)..(613): ta-siRNA initiation site
gtcagggtccacagggacagccctctcgcttttgtaaacctttttttctagtttcttcttctatacttccaccaccaccatcccatcccttattctccattttctctccctctcaaaaaccaaagctcaaaccctcaggcttcttcaaggttgattgattaccaggttacaagttgtcatcatcatcatcatcatcatcatcatgatggacatattcttcaataaacctaataccatcatggttattgacagcatatgcttcaaaagagcaatctccaccatggatgttgttgaacaatacttaccaagcttctttacaacaatggcttgttgacctctctcttggtgctatcccacctgagcttatttttaacaatccccccctccccccccccccaaaaaaaaaaaaactacccttttttttatttcaccatggtttcctcttcttgaccttgtaaggccttttcttgaccttgtaagacccctaccatcacctactacactaatcaccaatatcttaaaccatttcttatcagaattttccttgaaagaactaaacaattagtacccactgttcccacctaactcatcatctccttccctgtctatccctcctgagctaccatgtcacaataaaaaaactagaatattatttaccttacaaaaatggcaatggcatcatgcagtcaaaggagcttcatgggttttagttttacttccattttactgaaatgattgttgggctataagcagtcatttcag

SEQ ID NO: 5 - DNA, 1052 bp, Glycine max
  misc_feature (448)..(468): D8
  misc_feature (469)..(489): D7
  misc_feature (490)..(510): D6
  misc_feature (511)..(531): D5
  misc_feature (532)..(552): D4
  misc_feature (553)..(573): D3
  misc_feature (574)..(594): D2
  misc_feature (595)..(616): D1
  misc_binding (605)..(626): miR390 binding site
  misc_feature (617)..(617): ta-siRNA initiation site
acgagaaaaagtcctctctctctctctctctttcacactctcactttttctgtgcttctcttctctctcctttcaccctcttggaataatagagtagggagaaaaaaaagggtctcaaagatgagaccaaaagacgggtttttcatcaaaggtccctataagggagggttttttctcatgcatgtggctagcagcagcagcaagtgcaaggtggccatgagcatgaccatggtcaacgaccctttgaggagaattgggaggtgtgaccaaaaaaaagaagccattagtggctctgaaattggagctgacaattctcctgcagcaggagcagcttcttcattctaatctggtgctatcctatctgagctttttactactactactaccctttctttcttcatctaatttctaccacacttttctctttgtttttcccttggagtcttcttcttgaccttgtaagaccttttcttgaccttgtaagacctcacaccctatctcttctctttgtttttgcttttgtggaagaccctgtatcactatccactgatatagagtttgatctccttctttccccgttaccacccaactcatactttccttccttgtctatccctcctgagctgttccaatttaattaatttggcctaccatatatgatgcaacaatttaatgtaatattatgccataccatggtatcatatggtatggtatagcttcatagaaattaattaaggaccttaccttaaccttagaagttacaacctctgccaaatgtgttgttagctatttggagaccatggcttccaagagagtacaacaattggggtatattatttttattttatttgatattttttttttatcttggtgagaaattaatgtagttcgtgcagcatcatggttggtcgtggtccttaaggtatctgtggtaagttgtaaagagtggccatagttaataataaatcaatgctgctagtattcagaggaaattcaaaagccaaatctgtatcatatatatttctgttatggcaatcaatttcgcttgtatc

SEQ ID NO: 6 - DNA, 516 bp, Brassica napus
  misc_feature (249)..(269): D8
  misc_feature (270)..(290): D7
  misc_binding (405)..(426): miR390 binding site
  misc_feature (417)..(417): ta-siRNA initiation site
tcttaaatggaacagagagaagagctctcatggatgaaagaagcgaaacaggagtttctccaaggcagtagcgtgaacataaacctcatgatgcatagagattattgggtccgttgtgctgaaacattaagtttcttttcggaactccaattacattgataatctggtgttatcccaacttgagctcattttcagtttttttttaaaattttattaaaacttctttctcccactgaatgatttttattttcttgaccttgtaaggccttttcttgaccttgtaagaccccatccctttctaagtgtctccttcttctatcattttacagattttcttttatcttttttggtgtaagatatgtatgtatatctacccctagtttgtctgagtcatcttctcctaccttgtctatccctcctgagctagtccttgcatctttttgttagtccattgatgtatggttgatataaatttcaaaaaaagaacttagttttaacaaaaaaaaaaaaaaaaaa

SEQ ID NO: 7 - DNA, 852 bp, Helianthus annuus
  misc_feature (322)..(342): D8
  misc_feature (343)..(363): D7
  misc_binding (478)..(499): miR390 binding site
  misc_feature (490)..(490): ta-siRNA initiation site
ccggtcgaattccgggcgacgatttcgtctttctctctctctagtcctggctgcaggtttcatggctctagcgacgtacttggaacacccgcaggagaagatatgaagtttcaaatcctatgaatgttgacgcggatcatggcggcgcctttggcatagtcatgaagggtatagaggacgagggggagaagaagaaggcggtgcttgtttgttgttgatgaatttggcgctatccttacctgagcttttaccttgatctttctttctttctttattatattttttgatttgttgcctttttttctttttgtgattcttattttcttgaccttgtaagaccttttcttgaccttgtaagacccggtgatatgttatgtgtcttaagcgtttactatcgcctagatcttaactcatcacatagtcttaaaaggtcactctactattttcttccctcccacccaacctaggttctccttccttgtctatcccttctgagctatttcgtcctgttactaagagacacttaaagtgtttgttccaactttgatgtagttggtggaaacaaaccttagtgtctcttctttattagacaaaaagagactataattcttcatctccatcaacaaacgcaatgccgaatcttcaatttatgtcaaaaatgcatcctaacgcgtcttgggttgcggcgacgatttgaaagagaaaagaagagtgaagattgtaacatatatattcaagatctaagtcaaattcatcctttatttattttctttccattatacaatgaaatgttatattataaggttctatttaagtgaaaaaaattaagatgccaaaaaaaaaaaaaaaaaa

SEQ ID NO: 8 - DNA, 581 bp, Hordeum vulgare
  misc_feature (398)..(418): 5' D5 (+) phase
  misc_feature (419)..(439): 5' D4 (+) phase
  misc_feature (440)..(460): 5' D3 (+) phase
  misc_feature (461)..(481): 5' D2 (+) phase
  misc_feature (482)..(503): 5' D1 (+) phase
  misc_binding (492)..(512): miR390 binding site
  misc_feature (503)..(503): Initiation site of ta-siRNA
cagccactactactagtactacatctccgaagaatctacagagatcttcatccccaactcagcggcagtaattgttttcaagatggccaatgacgaggattcactagaggatcaaaaccctaaatcttggactgttagcaacgctagtatcattgacaagaaagaagaagcatccagcaagttctcggtccaggatcatcaaccacaaagagcagtagtcaacttcttaaaggatgaaagtactaccaaaacgatccatgagcaatggcaagaaaaagctaaggttgtctcgtagcctataagccggtgttatcccgaatgagctttcttatcccaaaccctcccatatgtctcttgttaaatcattttctggctactcctcgtgtcagaattaacgttcttgaccttgtaaggccttttcttgaccttgtaaggccctcccctaacgtttctcgtgcatcctggtgtctccaacctcacactttctttcccctttctatccctcctgagctattccctattttgtacgtctacaatctagatgagatattatatttgaataaaaaaaaaaaaaaaaaaaa

SEQ ID NO: 9 - DNA, 552 bp, Lycopersicon esculentum
  misc_feature (357)..(377): D8
  misc_feature (378)..(398): D7
  misc_binding (514)..(535): binding site of miR390
  misc_feature (526)..(526): ta-siRNA initiation site
ctcctctatgatctttctttagtttgtgcactttttgtgggtttgagagcaaatattgcactgcagaaaagaacactgaaatctccacaaggtagcatgtatgagtggattaataatgagtcagcttgcttcaacccaaaggctgcaaaaactgcaaagtataagcagaatgacatgtttagtggtccttcttagctatggctttggctttctcttcgtcttcctaacgatgagtgtcgcatcctcatcttaatctcggtgctatcctacctgagctttttctcaccgcttttttttttctgttgtgtattctcttttttgacttgttgcctttcgttcctctacctaccccattcttcttgaccttgtaagaccttttcttgaccttgtaagaccccgtgttatctcttacgtctttatgtttcgtttttttgcaaatcttacgtcatgacttcttcatgtaagctttgtttggtctccttcttctttcctactcaactctcgtcctccttccttgtctatccctcctgagctgttgattttattccatgt

SEQ ID NO: 10 - DNA, 829 bp, Sorghum australiense
  misc_feature (405)..(425): 5' D6 (+) phase
  misc_feature (426)..(446): 5' D5 (+) phase
  misc_feature (447)..(467): 5' D4 (+) phase
  misc_feature (468)..(488): 5' D3 (+) phase
  misc_feature (489)..(509): 5' D2 (+) phase
  misc_feature (510)..(531): 5' D1 (+) phase
  misc_binding (521)..(541): Binding site of miR390
  misc_feature (531)..(531): Initiation site of ta-siRNA
acaccacacacacaaacacactcaacacttgagctgggagaagctgaggcgttttcgttctccttctcgtgccgctggccggccggcccggctggtggctacctagctagctcgatcgtgttatctcgtacaaagcttggagtcgaattgaaggcacgatgaaactctgcagcgttgcggcggagaggagctctgtgaccggcaagccccatgtgcaggaagtgtccgcttggcatgaagagccgagagagcgtccggtgtggccaccgggagcagcagttcagatggttcatgcgtagtattatcatggcgttatcctgattgagcttttcattcaagccaccgttctcatccttcttcatattctttgtatcccaatgtttgtggtttcgcaaggtgaggtcttcttgaccttgcaagaccttttcttgaccttgtaagacccaactctgcgacatctctttccttcgactcaatcttctctgtcttacaccttcctcttcattcttacttcttttctatgtctatcccttctgagctgtgttgagctatgttaggtcctagttaagtattttagggtataggtgtgttcaccgtgaggtgaatagctagtgtgttgcctctcatatgtgtaatgatatgaactctcattgtgaaaaactatccctttgttgtatattttgttttgatggttgctagtgtgctgtagatgaaacatacaaaagcatgttcctgttgcgccatgagcccatgatgctcaggcatgtgaagtaggcgcctacttgtactgcttcaatggaataagatggctatgtctgcttcaaacatt

SEQ ID NO: 11 - DNA, 857 bp, Picea
  misc_feature (154)..(174): D8
  misc_feature (175)..(195): D7
  misc_binding (311)..(332): binding site of MiR390
  misc_feature (323)..(323): ta-siRNA initiation site
gtccaaacccatgtcattcactcatgcaaatattggatctgaaatcgccctctgcatgggcttaaagtcccatttaacccttacgcagatcgaagttcctcatgactgatccgcagccttgtgttcgtttgccatcacccccaaactgagcctttcttgaccttgtaagaccttttcttgaccttgtaagaccagccatagaatcccgagaacagcgccaccatttcgactcctcgcccaattctactgtaagttactggccataggactggcaatgaggtcgctcaactctcaaacaatcttcttctaattagtctatccctcctgagctatttacagttgagtttcaagttcttccagtcttctctctaattggaagtttgggtatgcatgcatgtcgatcgtagcaatttttaggtcatccagattcatcagtttctgtgattgcctgagcaggattacaagatatgcatggagctcccaatcgttttcccttagggtttggctgattctagttgagtgttttcacttctttgaaaaattgcgaggagtttcgtattcaatacacagagtttttgttatagctggatagattctgcatgaaatccatacatatgggggggcggggtttgggcaaaggctatcctgtttatgcaggattagttcctcatgttctgaattgtacttttttgtatctatatgaatgttagatcgatttccaggacataaactgttctgttttgtacatctcacagaaaactgtatcaaaggctgttcgtcactgctctttctgtatttcaatcaatctattcaatatttttcaatgataattaatgcagaaaaaattggattcaatg

SEQ ID NO: 12 - DNA, 508 bp, Theobroma cacao
  variation (1)..(508): "n" in the sequence meaning A or T or C or G
  misc_feature (226)..(246): D8
  misc_feature (247)..(267): D7
  misc_feature (274)..(274): n is a, c, g, or t
  misc_feature (276)..(276): n is a, c, g, or t
  misc_feature (301)..(301): n is a, c, g, or t
  misc_feature (304)..(304): n is a, c, g, or t
  misc_feature (333)..(333): n is a, c, g, or t
  misc_binding (382)..(403): binding site of miR390
  misc_feature (394)..(394): ta-siRNA initiation site
  misc_feature (468)..(468): n is a, c, g, or t
ggcaccaggtgatgcatgggagtatgatcaagggcaagcgagtactgtcaaggaataaaattattgatgaattatttcaatttagtacctgtaactcatgtgtgacagtggcttgttcatcttaattgggtgctatcctacctgagcttttttttcactcttttttttttttaatgcccttcattcttacttctttcgatttctttttcttcttcttttcttatcttcttgaccttgtaagaccttttcttgaccttgnaagaccccgttcggngntccttggttttgtttttctctccgntgnagactctatatcagaactttctgatgtanagtttgcgtattcttctaccccattcccgccaacttttcttctcccttccttgctatccctcctgagctggttgaattagcctagcctagctatagttaagctagcatttctcctcaaaattgttctgatcacantaccaaaaacgaccacctgatcaactcccattctggggtt

SEQ ID NO: 13 - DNA, 1056 bp, Vitis vinifera
  variation (1)..(1056): "n" in the sequence meaning A or T or C or G
  misc_feature (7)..(7): n is a, c, g, or t
  misc_feature (33)..(33): n is a, c, g, or t
  misc_feature (96)..(96): n is a, c, g, or t
  misc_feature (298)..(318): D8
  misc_feature (319)..(339): D7
  misc_binding (454)..(475): bindng site of miR390
  misc_feature (466)..(466): ta-siRNA initiation site
aaacatncatcactctttcttctctacggaggncatggacaaattttcacggcaaaaagcattcgcgaaacttccacagggtgactatgatgaagncattctcatgtttggtcaccaccacaacatctcggaaaagtatgatggcaatgagagggagctcctctttggtgaagacattgatcgcgggttggtgaccgaggctggttggtgttaattgggtgctatcctacctgagctttttcttcgtttttttttttatatttttcatcgttttttttttattctctttttctcgtcttcttgaccttgtaagaccttttcttgaccttgtaagaccctgttgtgcgcatttcttcttcgttttccatcttgtcatgaactctataccagcaccgactgacatagagctcggccatcgtgttccccgtttccgcccaactcatgttctccttccttgtctatccctcctgagctattggaattgaaccaacaccctcccctcaaaattctcgacaatgatagtaatgggcttcatttgtgacatgtaaatctagtagagaaagaaaaagaatgttaattttgaggtagagaaaaagagagagttgtaaagagtactgaaatggaaaaggattgatcagatataaggtgttttggggtgttgacagaataatagtatttgctgtctttccagtttccactattcatttacagccatcaatttcgattggtattatatgggcagaaatatgctgttgcaggcagcagtttcgttgttttatatgttgtttggctgagaagtgagtagagaataaatattcttctgcagatctgtgaagacttaattcccctcgtgactgctcttatgtacaaaatatccactgtattattggagttttctctctctcactctctctctctctggtttcttccatctttatctgagctcatttcatttatgaggtgtggaaaaaactcacttgttacaagaggggaaatcagcttttctttgcttaaggacaactttgctgcttgaagaaggcttttgctcagagcttc

SEQ ID NO: 14 - DNA, 513 bp, Lotus japonicus
  misc_feature (56)..(76): D8
  misc_feature (77)..(97): D7
  misc_binding (213)..(234): binding site of miR390
  misc_feature (225)..(225): ta-siRNA initiation site
aatttctaccaccgcgcttctctgtcttcttttttccttgtttccccctccggtcttcttgaccttgtaagaccttttcttgaccttgtaagacctcacgccgtgtctgttttcttcatttttgcttttgtggaagaccctatgtcagaaaccactgacatagggtttgatcttcgtctttccccgttaccgtccaactcatcctctccttccttgtctatccctcctgagctatttcaattttggccaagcatgccacaatattatgtgaaatgtgctgccaatttgagaccatgactacttcaaactacaattgggttattttctatttgaatttttgttctcttattatatgagaaatgtagtttgtgaagcatgcttcatagtggtccttaaggtaggttacgccagagataataaattgatgtttgttgtattcatatgaattcaaaagccagcatattctgtatcttgttctgttaaggcatcatttgggtttgtattattgtgtgc

SEQ ID NO: 15 - DNA, 1595 bp, Populus
  misc_feature (937)..(957): D8
  misc_feature (958)..(978): D7
  misc_binding (1094)..(1115): binding site of miR390
  misc_feature (1106)..(1106): ta-siRNA initiation site
ttttttttgcaatgcataatgcatgtaattaagctatacgtctccttttatttagtacagactagctagagataatagctggacatgtttaatgttaatcctgaccgccgaaaaggatcaagaggctctaccacatatctgaagccttggccgatgatcaacatttatcgtatgaaaactggataaaaaaaaaaagaaaaagaaaagactacttattctgcttgttcagcaccagcgaagtacagtactaccgaattaatgcatgtgtaaatatcacttaatactgccatctgatcaaatccatatagctcctgccttcctaagcaaagagcctagctcattcctgacttgtaagctcatgacttgcttatcaccaccaacaaactcttggcctatgaaaacagttggtacacttggctgacatcctagctgctgtactaatgctctttcaatttgcttcccgtttggaatttgatctagctcataaactgtaggatttgccccaaagctagatataagtgttttaatggagtggctcatgcaacaagtgctcctgctaaaaatcaccactggcctgtccgcaaccaaccttctcacgatatccatatctacgaagaattaacagaagttgagtttgtaaagggaatattatgtcttcacacttgacagcctcttttgcccccactccctctctcaaaacatgagggaaagagagaagggtctttcaaaggtgaaagaaaggcacaagtttctgcaaggtaacctgtataagggtatgaacaaagccatcatgtgttacactacaagccaggaaggaagcctagtagatggattctttgctggctttcaaaaggcggtttcttcatgttaagtggccggtgctatcctacctgagctttttctattatctcttcgtttttttttttttgtttttttttcttgaccttgtaagaccttttcttgaccttgtaagaccccattttttgttctttgtttctattttttgtattatcatcaactttacatcaaaatgtcttgatgtagagttttgactaattttttccccgtttccgtccaactcatcttctccttccttgtctatccctcctgagctatgagctgtttgaattagactaaataacatttcccttcaaaatcacccaatcaagtacaaatcaaaaacctctcgaagttcatgcaagcgatggagccttacttgccatgtggggtttacgttttcttacatgtgaactattggaggaagaaatcaacaagtttgagctaagtgttcattgaggagctaggtaagagctttaaagagtacttgaatcgcttgtaaaagtctttgtctttctttctctgtaaaaaataaagaaagactcgtctttcttattctctgcacgttaaggccatcaatttagattgttgttagtgtatgcgtgtgcagaaatatgctgttgcagacatcagtttcattgttttatatgttgttgtctcagaagtgagtaagtaaatattctctcagatctgagtgtgtaagagttctcctcgtgactgctcttatgtacaatacaaaatattcatgtatccactgt

SEQ ID NO: 16 - DNA, 799 bp, Arabidopsis thaliana
  misc_binding (424)..(445): miR173 binding site
  misc_feature (436)..(456): 3' D1
  misc_feature (457)..(477): 3' D2
  misc_feature (478)..(498): 3' D3
  misc_feature (499)..(519): 3' D4
  misc_feature (520)..(540): 3' D5
  misc_feature (541)..(561): 3' D6
  misc_feature (562)..(582): 3' D7
  misc_feature (583)..(603): 3' D8
aggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcctaagtccaacatagcgttcgataagatcttagaaaattattttaagtctaacatagcgtttgattggatcttaggaaattattctaagtccaacatagcgtagagaaatggaagatatcgtgaatgatatttgtagtaatggcgaaactagaaaaagcattggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggc

SEQ ID NO: 17 - DNA, 1606 bp, Arabidopsis thaliana
  misc_binding (580)..(601): miR173 binding site
  misc_feature (592)..(612): 3' D1
  misc_feature (613)..(633): 3' D2
  misc_feature (634)..(654): 3' D3
  misc_feature (655)..(675): 3' D4
  misc_feature (676)..(696): 3' D5
  misc_feature (697)..(717): 3' D6
cccagttaagtttcaacgtgactataagtaatatattcttttccaataaaaaaaaaacagagttaaacaatttgacaaaatatatccaactttaataagattgccgtatacataccaatttgacccaaaaaggctttgtactctttacataacaaaaaaggtcaaatagggaaaacgatgggactttataaacccaagtcactcattaccgacctcataaatctaaacctaagcggctaagcctgacgtcatttaacaaaaagagtaaacatgagcgccgtcaagctctgcaactacgatctgtaactccatcttaacacaaaagttgagataggttcttagatcaggttccgctgttaaatcgagtcatggtcttgtctcatagaaaggtactttcttttacttctcttgagtagcttctatagctagattgagattgaggttttgagatattaggttcgatgtcccggtctatttgtcaccagccatgtgtcagtttcgaccagtcccgtgctctctgtatttggttttatcggaatacggagatctattttcaggaggagacaactttgttttcttgtgatttttctcaacaagcgaatgagtcattcatcggtatctaaccattcaccatattatcagagtagttatgattgataggatggtagaagaatattctaagtccaacatagcatattctaagtccaacatagcgtaaaaaattgggagatatccggaatgatattatacgtaaaaaaaaatgggagatgtccggaatgatatttgtaatatttttatgttaacgaaacatattttaggatatgcaaaaaaaagtagatgttggtattcttgttttgcaagatttgtaatgggagttgtgtagtctttttatgatgtgtcatgaagtctaccgccaattacatacatcattcactttgtaattaaattgtcttcaagtttgtaattttatttttgttttatgtaccaaaatctaaattcagttgtttacaacttgataacaaaaaaaaagttatacattacttatgttttcacactcaatgattcaagttttttctatatccattcgaaagcttcttattaatcatcatacatggatttttactgctttgtatatttgtagtttacaactgtagtggattaatatcattcatttagcaacaacaacactcgttaagtttgctcacttgtcataattataaaccaacgcatgcatcacatatataagtaaatgcaaaacctatgcagctattatcaaagtcttcacttctcaaacgtgcttcaatcacttcaccctcagctgcactgaccaaccaaccgtaaacgcaactttcactttttcgtcactgagccatctctccttttcaaatcaaagttgaacagagcctaccagtggcaagtgaagggcttttctgaaacttatttctcaactgaccacaagcagcactcgctccaagtcctcttgtttgccttacgcttgctgttatcttacgcgacttcaatgcagctgcaaacgctaggacctgtacaattggttaataaaagcgattatttatttattgagcttttgaatccaaaaccaaaccag

SEQ ID NO: 18 - DNA, 1180 bp, Arabidopsis thaliana
  misc_binding (544)..(565): miR173 binding site
  misc_feature (556)..(576): 3' D1
  misc_feature (577)..(597): 3' D2
  misc_feature (598)..(618): 3' D3
  misc_feature (619)..(639): 3' D4
  misc_feature (640)..(660): 3' D5
  misc_feature (661)..(681): 3' D6
ggggaaattgttattcaaacaaagattattctataaaataaatagttcaatttgtttcctttgttcttgttatactttactaaacatatatattctttacttaacaaaattgtaaggttaaatagggaagcgttggcattatatatataaacccaagtcagtcattatcgacctcacaaacctaaacctaaacggctaagcccgacgtcaaataccaaaaagagaaaaacaagagcgccgtcaagctctgcaaatacgatctgtaagtccatcttaacacaaaagtgagatgggttcttagatcatgttccgccgttagatcgagtcatggtcttgtctcatagaaaggtactttcgtttacttcttttgagtatcgagtagagcgtcgtctatagttagtttgagattgcgtttgtcagaagttaggttcaatgtcccggtccaattttcaccagccatgtgtcagtttcgttccttcccgtcctcttctttgatttcgttgggttacggatgttttcgagatgaaacagcattgttttgttgtgatttttctctacaagcgaatagaccatttatcggtggatcttagaaaattattctaagtccaacatagcgtattctaagttcaacatatcgacgaactagaaaagacattggacatattccaggatatgcaaaagaaaacaatgaatattgttttgaatgtgttcaagtaaatgagattttcaagtcgtctaaagaacagttgctaatacagttacttatttcaataaataattggttctaataatacaaaacatattcgaggatatgcagaaaaaaagatgtttgttattttgaaaagcttgagtagtttctctccgaggtgtagcgaagaagcatcatctactttgtaatgtaattttctttatgttttcactttgtaattttatttgtgttaatgtaccatggccgatatcggttttattgaaagaaaatttatgttacttctgttttggctttgcaatcagttatgctagttttcttataccctttcgtaagcttcctaaggaatcgttcattgatttccactgcttcattgtatattaaaactttacaactgtatcgaccatcatataattctgggtcaagagatgaaaatagaacaccacatcgtaaagtgaaatgacaattcgggta

SEQ ID NO: 19 - DNA, 659 bp, Arabidopsis thaliana
  misc_binding (214)..(235): miR173 binding site
  misc_feature (226)..(246): 3' D1
  misc_feature (247)..(267): 3' D2
  misc_feature (268)..(288): 3' D3
  misc_feature (289)..(309): 3' D4
  misc_feature (310)..(330): 3' D5
  misc_feature (331)..(351): 3' D6
agtcctttctatgagtagcctatcatagcatcttctatagctttaggttgggtttgggagtgagtttacgagttacaagttggtttaatgataatatcttggatgatacaatggatttgttaccaagcatgtgtcagtcacggctcctcctctctgttttttggtttcactagaataaatacggcggtttacgagttgaaacgacatggttttgtgatttttctctccaagcgaatgatgatacttaaactattcacttgattatagtttgaacttgtgtattttgaaacacgatgttcaatagatttagatggtagttcaagtattccagatggtagaaatgggatatacatatatgtttcagtcttatccccgtaaaaaaagttgtaactcttgttgatcggatggtagaaacataggtctttaatcccatataggtattcgagtatatgcaaaagagtaagatggatcttgataatctttgttttagtaaacatataagattcattttatatcttttgtaatactaaacatattcatggatatgcaaaaagaaaactaggtatatggttgtgtgatgaagaaattacaaaagacatcattgatgtttgaggatatatgtcgaaagtgaagtttttagcaaactatgttgaaagagc

SEQ ID NO: 20 - DNA, 1200 bp, Arabidopsis thaliana
  misc_feature (866)..(886): 5' D8
  misc_feature (887)..(907): 5' D7
  misc_feature (908)..(928): 5' D6
  misc_feature (929)..(949): 5' D5
  misc_feature (950)..(970): 5' D4
  misc_feature (971)..(991): 5' D3
  misc_feature (992)..(1012): 5' D2
  misc_feature (1013)..(1033): 5' D1
  misc_binding (1022)..(1043): miR390 binding site
ccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggc

SEQ ID NO: 21 - DNA, 20 bp, Artificial sequence
  Oligonucleotide primer MW-P1F
aggtcaaataaggaaaacga

SEQ ID NO: 22 - DNA, 22 bp, Artificial sequence
  Oligonucleotide primer MW-P2R
gccttgcaaaataagaatacca

SEQ ID NO: 23 - DNA, 3616 bp, Artificial sequence
  Gateway cloning entry vector containing Arabidopsis ta-siRNA TAS1a (At2g27400).
  terminator (268)..(295): rrnB-T2
  terminator (427)..(470): rrnB-T1
  misc_recomb (569)..(668): attL1 recombination site for gateway cloning
  gene (678)..(1485): ta-siRNA-At2g27400 gene
  misc_feature (1106)..(1127): miR173-binding-site
  misc_feature (1118)..(1138): D1 phase in ta-siRNA
  misc_feature (1139)..(1159): D2 phase in ta-siRNA
  misc_feature (1160)..(1180): D3 phase in ta-siRNA
  misc_feature (1181)..(1201): D4 phase in ta-siRNA
  misc_feature (1201)..(1222): D5 phase in ta-siRNA
  misc_feature (1223)..(1243): D6 phase in ta-siRNA
  misc_feature (1244)..(1264): D7 phase in ta-siRNA
  misc_feature (1265)..(1285)
  misc_recomb (1495)..(1594): attL2 recombination site for gateway cloning
  promoter (1729)..(1862): p-Spec
  misc_feature (1863)..(2873)
  rep_origin (2940)..(3613): pUC-Ori
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcctaagtccaacatagcgttcgataagatcttagaaaattattttaagtctaacatagcgtttgattggatcttaggaaattattctaagtccaacatagcgtagagaaatggaagatatcgtgaatgatatttgtagtaatggcgaaactagaaaaagcattggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 24 - DNA, 3616 bp, Artificial sequence
  Gateway entry vector containing TAS1a/GUS-M.  It is identical to pRMW1 except that 3'D2(+), 3'D6(+) and 3'D8(+) are each replaced with a 21-nt sequence targeting to GUS middle region, and AT(1300-1301) in pRMW1 is mutated to CA(1300-1301) to create a
  misc_recomb (569)..(668): attL1
  gene (678)..(1485): engineered ta-siRNA gene targetting to a 5' region in GUS gene
  misc_feature (1139)..(1159): 3'D2(+)-GUS-M1346
  misc_feature (1181)..(1201): 3'D4(+)-GUS-M1346
  misc_feature (1223)..(1243): 3'D6(+)-GUS-M1346
  misc_recomb (1495)..(1594): attL2
  promoter (1729)..(1862): attL2
  misc_feature (1863)..(2873)
  rep_origin (2940)..(3613): pUC-Ori
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcataatcgcctgtaagtgcactccgataagatcttagaaaattataatcgcctgtaagtgcactctgattggatcttaggaaattataatcgcctgtaagtgcactcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 25 - DNA, 3616 bp, Artificial sequence
  pRMW006 is identical to pRMW005 except in the regions 3'D2(+)-GUS M1346, 3'D4(+)-GUS M1346 and 3'D6(+)-GUS M1346.
  gene (678)..(1485): engineered ta-siRNA gene targetint to a 3' region in GUS gene
  misc_feature (1139)..(1159): engineered 3'D2(+) phase targeting to GUS-C1585 region
  misc_feature (1181)..(1201): engineered 3'D4(+) phase targeting to GUS-C1585 region
  misc_feature (1223)..(1243): engineered 3'D6(+) phase targeting to GUS-C1585 region
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattaccatccgtaataacagtccgataagatcttagaaaattattaccatccgtaataacagtctgattggatcttaggaaattattaccatccgtaataacagtcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 26 - DNA, 3616 bp, Artificial sequence
  pRMW007 is identical to pRMW005 except in the regions 3'D2(+)-GUS M1346, 3'D4(+)-GUS M1346 and 3'D6(+)-GUS M1346.
  gene (678)..(1485): engineered ta-siRNA gene targetting to three different regions in GUS gene
  misc_feature (1139)..(1159): engineered 3'D2(+) phase targetting to GUS N215 region
  misc_feature (1181)..(1201): engineered 3'D4(+) phase targetting to GUS M1346 region
  misc_feature (1223)..(1243): engineered 3'D6(+) phase targetting to GUS C1585 region
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatacctttcggtataaagcctccgataagatcttagaaaattataatcgcctgtaagtgcactctgattggatcttaggaaattattaccatccgtaataacagtcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 27 - DNA, 3616 bp, Artificial sequence
  pRMW008 is identical to pRMW005 except in the regions 3'D2(+)-GUS M1346, 3'D4(+)-GUS M1346 and 3'D6(+)-GUS M1346.
  gene (678)..(1485): engineered ta-siRNA gene with 3'D2(+), 3'D4(+) and 3'D6(+) containing a random 21nucleotides sequence.  This vector is used as a negative control.
  misc_feature (1139)..(1159): engineered 3'D2(+) phase containing a random 21bp sequence.
  misc_feature (1181)..(1201): engineered 3'D4(+) phase containing a random 21bp sequence.
  misc_feature (1223)..(1243): engineered 3'D6(+) phase containing a random 21bp sequence.
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcactcacgtgaatgtccgctaatcgataagatcttagaaaattactcacgtgaatgtccgctaattgattggatcttaggaaattactcacgtgaatgtccgctaatgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 28 - DNA, 24 bp, Artificial sequence
  Oligonucleotide primer MW-P17F
agcttgactagagaattcgaatcc

SEQ ID NO: 29 - DNA, 23 bp, Artificial sequence
  Oligonucleotide primer MW-P18R
gatccgggctgcacatacataac

SEQ ID NO: 30 - DNA, 3683 bp, Artificial sequence
  Gateway entry vector for PcUbi4-2 promoter
  terminator (157)..(184): t-rrnB-T2
  terminator (316)..(359): t-rrnB-T1
  misc_recomb (482)..(577): attL4
  promoter (597)..(1592): parsley ubiquitin promoter p-PcUbi4-2
  misc_recomb (1614)..(1770): attR1, complementary
  misc_feature (1966)..(2775)
  rep_origin (2896)..(3569): 0-pUC
agcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggcccgagttaacgctaccatggagctccaaataatgattttattttgactgatagtgacctgttcgttgcaacaaattgataagcaatgcttttttataatgccaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagttgaacgagaaacgtaaaatgatataaatatcaatatattaaattagattttgcataaaaaacagactacataatactgtaaaacacaacatatgcagtcactatgaaccaactacttagatggtattagtgacctgtagaattaattcgagctctagagctgcagggcggccgcgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 31 - DNA, 9190 bp, Artificial sequence
  pRMW13 is a binary vector for expressing engineered TAS1a gene in plant.  The engineered 3'D2(+), 3'D4(+) and 3'D6(+) phases target to a middle region in GUS  gene.
  misc_recomb (1)..(14): attB3 second part, complementary
  misc_feature (379)..(1173)
  rep_origin (1470)..(2151): o-ColE1
  rep_origin (1891)..(2151): o-BOM-ColE1
  rep_origin (2561)..(3561): VS1-rep
  misc_feature (4154)..(5155): VS1-sta
  misc_feature (5601)..(5815): b-LB
  terminator (5833)..(6085): t-NOS, complementary
  misc_feature (6127)..(6678)
  promoter (6688)..(6974): p-NOS, complementary
  misc_recomb (6988)..(7008): attB4
  promoter (7028)..(8023): p-PcUbi4-2
  misc_recomb (8045)..(8065): attB1
  gene (8078)..(8885): engineered ta-siRNA gene targetting to a 5' region of GUS gene
  misc_feature (8518)..(8538): 3'D1(+)-ta-siRNA
  misc_eature (8539)..(8559): 3'D2(+)-GUS-M1346, engineered 3'D2(+) phase targetting to GUS M1346 region
  misc_feature (8560)..(8580): 3'D3(+)-ta-siRNA
  misc_feature (8581)..(8601): 3'D4(+)-GUS-M1346, engineered 3'D4(+) phase targetting to GUS M1346 region
  misc_feature (8602)..(8622): 3'D5(+)-ta-siRNA
  misc_feature (8623)..(8643): 3'D6(+)-GUS-M1346, engineered 3'D6(+) phase targetting to GUS M1346 region
  misc_recomb (8898)..(8918): attB2, complementary
  terminator (8924)..(9176): t-NOS
  misc_recomb (9184)..(9190): attB3 first part, complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcataatcgcctgtaagtgcactccgataagatcttagaaaattataatcgcctgtaagtgcactctgattggatcttaggaaattataatcgcctgtaagtgcactcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 32 - DNA, 9190 bp, Artificial sequence
  pRMW014 is identical to pRMW013, except in the 3'D2(+), 3'D4(+) and 3'D6(+) regions.
  gene (8078)..(8885): engineered ta-siRNA gene targetting to a 3' region of GUS gene
  misc_feature (8539)..(8559): 3'D3(+)-GUS-C1585, engineered 3'D2(+) phase targetting to GUS C1585 region
  misc_feature (8539)..(8559): 3'D3(+)-GUS-C1585, engineered 3'D2(+) phase targeting to GUS C1585 region
  misc_feature (8581)..(8601): 3'D4(+)-GUS-C1585, engineered 3'D4(+) phase targetting to GUS C1585 region
  misc_feature (8623)..(8643): 3'D6(+)-GUS-C1585, engineered 3'D6(+) phase targetting to GUS C1585 region
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattaccatccgtaataacagtccgataagatcttagaaaattattaccatccgtaataacagtctgattggatcttaggaaattattaccatccgtaataacagtcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 33 - DNA, 9190 bp, Artificial sequence
  pRMW015 is identical to pMW013 except in 3'D2(+), 3'D4(+) and 3'D6(+) regions.
  gene (8078)..(8885): NMC ta-siRNA GUS, engineered ta-siRNA gene targetting to three different regions in GUS gene
  misc_feature (8539)..(8559): 3'D2(+)-GUS-N215, engineered 3'D2(+) phase targetting to GUS N215 region
  misc_feature (8581)..(8601): 3'D4(+)-GUS-M1346, engineered 3'D4(+) phase targetting to GUS M1346 region
  misc_feature (8623)..(8643): 3'D6(+)-GUS-N215, engineered 3'D6(+) phase targetting to GUS C1585 region
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatacctttcggtataaagcctccgataagatcttagaaaattataatcgcctgtaagtgcactctgattggatcttaggaaattattaccatccgtaataacagtcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 34 - DNA, 9190 bp, Artificial sequence
  pRMW16 is identical to pRMW13 except for the 3'D2(+), 3'D4(+) and 3'D6(+) regions.  Each of this three regions was replaced by a 21-nt random sequence.
  gene (8078)..(8885): engineered ta-siRNA gene containing a random 21bp sequence at 3'D2(+), 3'D4(+) and 3'D6(+) phases.  This is used as a negative control.
  misc_feature (8539)..(8559): 3'D2(+)-Random, engineered 3'D2(+) phase containing a random 21bp sequence.  This random 21 nucleotide sequence was scrambled from 3'D2(+)-GUS M1346 sequence in pRMW005.  Blast indicated that it doesn't have homology to Arabidopsis genes.
  misc_feature (8581)..(8601): 3'D4(+)-Random, engineered 3'D4(+) phase containing a random 21bp sequence.  This random 21 nucleotide sequence was scrambled from 3'D2(+)-GUS M1346 sequence in pRMW005.  Blast indicated that it doesn't have homology to Arabidopsis genes.
  misc_feature (8623)..(8643): 3'D6(+)-Random, engineered 3'D6(+) phase containing a random 21bp sequence.  This random 21 nucleotide sequence was scrambled from 3'D2(+)-GUS M1346 sequence in pRMW005.  Blast indicated that it doesn't have homology to Arabidopsis genes.
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcactcacgtgaatgtccgctaatcgataagatcttagaaaattactcacgtgaatgtccgctaattgattggatcttaggaaattactcacgtgaatgtccgctaatgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 35 - DNA, 3689 bp, Artificial sequence
  Gateway entry vector containing NOS terminator
  promoter (103)..(224): p-Lac
  misc_recomb (274)..(369): attL3
  terminator (377)..(629): Nopaline Synthase poly-A terminator (complementary)
  misc_recomb (635)..(791): attR2 (complementary)
  misc_feature (1798)..(2757)
  rep_origin (2928)..(3516): ColEI
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcaaataatgattttattttgactgatagtgacctgttcgttgcaacaaattgataagcaatgcttttttataatgccaactttgtataataaagttggccggccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcgagctccactttgtacaagaaagttgaacgagaaacgtaaaatgatataaatatcaatatattaaattagattttgcataaaaaacagactacataatactgtaaaacacaacatatgcagtcactatgaaccaactacttagatggtattagtgacctgtagaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 36 - DNA, 8675 bp, Artificial sequence
  Gateway destination vector
  misc_feature (55)..(269): b-LB, complementary
  misc_selection (581)..(1132): c-Bar,complementary
  promoter (1142)..(1428): NOS, complementary
  misc_recomb (1442)..(1566): attR4
  misc_feature (1606)..(1911)
  misc_feature (2231)..(2911)
  misc_recomb (3019)..(3143): attR3, complementary
  misc_feature (3198)..(3343): b-RB, complementary
  misc_feature (3508)..(4302)
  rep_origin (4599)..(5280): ColE1
  misc_feature (5690)..(6690): VS1-rep
  misc_feature (7283)..(8284): VS1-Sta
ctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttgaacgagaaacgtaaaatgatataaatatcaatatattaaattagattttgcataaaaaacagactacataatactgtaaaacacaacatatccagtcactatggtcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggggactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcggcaaaagagccgttcatttcaatgaaccgggcgacctcagccatcccttcctgattttccgctttccagcgttcggcacgcagacgacgggcttcattctgcatggttgtgcttaccgaaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatcctctagattacgccccgcctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacggatcctaactcaaaatccacatattatacgagccggaagcataaagtgtaaagcctggggtgcctaatgcggccgccatagtgactggatatgttgtgttttacagtattatgtagtctgttttttatgcaaaatctaatttaatatattgatatttatatcattttacgtttctcgttcaactttattatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgct

SEQ ID NO: 37 - DNA, 20 bp, Artificial sequence
  Oligonucleotide primer MW-P11F
ccatatcgcaacgatgacgt

SEQ ID NO: 38 - DNA, 20 bp, Artificial sequence
  Oligonucleotide primer MW-P12R
gccagtccccttgatagcga

SEQ ID NO: 39 - DNA, 4017 bp, Artificial sequence
  pRMW002 is a  Gateway  entry vector for gateway cloning Arabidopsis ta-siRNA gene At3g17185 into plant expression binary vector.
  terminator (268)..(295): rrnB-T2
  terminator (427)..(470): rrnB-T1
  misc_recomb (569)..(668): attL1
  gene (683)..(1882): At3g37185-ta-siRNA
  misc_feature (1548)..(1568): At3g37185-ta-siRNA
  misc_feature (1569)..(1589): 5'D7(+)
  misc_feature (1590)..(1610): 5'D6(+)
  misc_feature (1611)..(1631): 5'D5(+)
  misc_feature (1632)..(1652): 5'D4(+)
  misc_feature (1653)..(1673): 5'D3(+)
  misc_feature (1674)..(1694): 5'D2(+)
  misc_feature (1695)..(1715): 5'D1(+)
  misc_recomb (1896)..(1995): attL2
  promoter (2130)..(2263): p-Spec
  misc_feature (2264)..(3274)
  rep_origin (3341)..(4014): pUC-ori
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 40 - DNA, 3616 bp, Artificial sequence
  pRMW023 is an entry vector in Gateway cloning.  The ta-siRNA sequences is engineered to target to PDS gene in Arabidopsis.
  terminator (268)..(295): rrB-T2
  terminator (427)..(470): rrB-T1
  misc_recomb (569)..(668): attL1
  gene (678)..(1485): PDS2-ta-siRNA, engineered ta-siRNA gene to target to PDS gene L16237 in Arabidopsis.
  misc_feature (1118)..(1138): 3'D1(+)-ta-siRNA
  misc_feature (1139)..(1159): 3'D2(+)-PDS-M1056, engineered 3'D2(+) phase containg a 21bp Arabidopsis PDS gene 987-1007.  Complementary.
  misc_feature (1160)..(1180): 3'D3(+)-ta-siRNA
  misc_feature (1181)..(1201): 3'D4(+)-PDS-M1056, engineered 3'D4(+) phase containing a 21 nucleotide sequence from Arabidopsis PDS gene AF360196 987-1007. Complementary.
  misc_feature (1202)..(1222): 3'D5(+)-ta-siRNA
  misc_feature (1223)..(1243): 3'D6(+)-PDS-M1056, engineered 3'D6(+) phase containing a 21 nucleotide sequence from Arabidopsis PDS gene AF360196 987-1007. Complementary.
  misc_recomb (1495)..(1594): attL2
  promoter (1729)..(1862): p-Spec
  misc_feature (1863)..(2873)
  rep_origin (2940)..(3613): pUC-ori
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattcctgaagaaaccggttcaacgataagatcttagaaaattattcctgaagaaaccggttcaatgattggatcttaggaaattattcctgaagaaaccggttcaagagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 41 - DNA, 3616 bp, Artificial sequence
  pRMW024 is identical to pRMW023 except in the 3'D2(+), 3'D4(+) and 3'D6(+) region.
  misc_feature (1139)..(1159): 3'D2(+)-PDS4, 21 nucelotide sequence from Arabidopsis PDS gene AF360196 1394-1414.  Complementary.
  misc_feature (1181)..(1201): 3'D4(+)-PDS4, 21 nucelotide sequence from Arabidopsis PDS gene AF360196 1394-1414.  Complementary.
  misc_feature (1223)..(1243): 3'D6(+)-PDS4, 21 nucelotide sequence from Arabidopsis PDS gene AF360196 1394-1414.  Complementary.
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattacaagttaaggacatgtcgcgataagatcttagaaaattattacaagttaaggacatgtcgtgattggatcttaggaaattattacaagttaaggacatgtcggagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 42 - DNA, 9190 bp, Artificial sequence
  pRMW25 is identical to pRMW013 except in 3'D2(+), 3'D4(+) and 3'D6(+) regions.
  gene (8078)..(8885): PDS2-ta-siRNA, engineered ta-siRNA gene targetting to PDS gene AF360196 in Arabidopsis.
  misc_feature (8539)..(8559): 3'D2(+)-PDS2, 21 nucleotide sequence from Arabidopsis PDS gene AF360196 987-1007.  Complementary.
  misc_feature (8581)..(8601): 3'D4(+)-PDS2, 21 nucleotide sequence from Arabidopsis PDS gene AF360196 987-1007.  Complementary.
  misc_feature (8623)..(8643): 3'D6(+)-PDS2, 21 nucleotide sequence from Arabidopsis PDS gene AF360196 987-1007.  Complementary.
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattcctgaagaaaccggttcaacgataagatcttagaaaattattcctgaagaaaccggttcaatgattggatcttaggaaattattcctgaagaaaccggttcaagagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 43 - DNA, 9190 bp, Artificial sequence
  pRMW26 is identical to pRMW13 except in the 3'D2(+), 3'D4(+) and 3'D6(+) region.
  gene (8078)..(8885): PDS4-ta-siRNA, engineered ta-siRNA gene to target to PDS gene L16237 in Arabidopsis.
  misc_feature (8539)..(8559): 3'D2(+)-PDS4, 21 nucleotide sequence from Aabidopsis PDS gene AF360196 1394-1414.  Complementary.
  misc_feature (8581)..(8601): 3'D4(+)-PDS4, 21 nucleotide sequence from Aabidopsis PDS gene AF360196 1394-1414.  Complementary.
  misc_feature (8623)..(8643): 3'D6(+)-PDS4, 21 nucleotide sequence from Aabidopsis PDS gene AF360196 1394-1414.  Complementary.
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattacaagttaaggacatgtcgcgataagatcttagaaaattattacaagttaaggacatgtcgtgattggatcttaggaaattattacaagttaaggacatgtcggagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 44 - DNA, 4298 bp, Artificial sequence
  A Gateway entry vector with recombination sites attL1 and attL2
  misc_recomb (376)..(381): attL1
  prim_transcript (392)..(1273): Maize ta-siRNA precursor initiated by miR390
  misc_recomb (1288)..(1383): attL2
  misc_feature (2506)..(3366)
  rep_origin (3537)..(4125): ColEI
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 45 - DNA, 21 bp, Artificial sequence
  A 21 nt fragment complememtary to DsRed2
ttgtagatgaagcagccgtcc

SEQ ID NO: 46 - DNA, 4298 bp, Artificial sequence
  A Gateway entry vector carrying engineered ta-siRNAs targeting DsRed2.pRPR58 is identical to pRPR57 except 5'D7(+) and 5'D8(+) phases replaced
  prim_transcript (392)..(1273): Engineered maize ta-siRNA primary transcript targeting dsRed 2 gene
  misc_feature (932)..(952): Engineered 5' D8(+) phase targeting dsRed 2 gene
  misc_feature (953)..(973): 5' D7 (+) phase targeting dsRed 2 gene
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgtagatgaagcagccgtccttgtagatgaagcagccgtcccactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 47 - DNA, 21 bp, Artificial sequence
  A 21 nt fragment complementary to DsRed2
ttgaagcgcatgaactcggtg

SEQ ID NO: 48 - DNA, 4298 bp, Artificial sequence
  A Gateway entry vector carrying engineered ta-siRNAs targeting DsRed2. pRPR59 is identical to pRPR57 except 5'D7(+) and 5'D8(+) phases replaced.
  prim_transcript (392)..(1273): Engineered maize ta-siRNA primary transcript targeting dsred 2 gene.
  misc_feature (932)..(952): Engineered 5' D8(+) phase targeting dsRed2 gene.
  misc_feature (953)..(973): Engineered 5' D7(+) phase targeting dsRed 2 gene.
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgaagcgcatgaactcggtgttgtagatgaagcagccgtcccactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 49 - DNA, 4242 bp, Artificial sequence
  A Gateway entry vector contains sugarcane bacilliform virus (ScBV) promoter flanked by two recombination sites attL4 and attR1
  misc_recomb (64)..(159): attL4
  promoter (162)..(1582): Sugarcane bacilliform virus [ScBV] promoter
  misc_recomb (1583)..(1739): attR1
  promoter (1933)..(2031): beta-lactamase promoter,
  misc_feature (2032)..(2892)
  rep_origin (3037)..(3710): pUC replication origin
cgacgttgtaaaacgacggccagtcttaagctcgggcccgagttaacgctaccatggagctccaaataatgattttattttgactgatagtgacctgttcgttgcaacaaattgataagcaatgcttttttataatgccaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagttgaacgagaaacgtaaaatgatataaatatcaatatattaaattagattttgcataaaaaacagactacataatactgtaaaacacaacatatgcagtcactatgaaccaactacttagatggtattagtgacctgtagaattcgagctctagagctgcagggcggccgcgatatcccctatagtgagtcgtattacatggtcatagctgtttcctggcagctctggcccgtgtctcaaaatctctgatgttacattgcacaagataaaaatatatcatcatgacatttaaatggacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtca

SEQ ID NO: 50 - DNA, 4128 bp, Artificial sequence
  A Gateway entry vector contains Glb1 promoter flanked by two recombination sites attL4 and attR1
  misc_recomb (593)..(688): attL4
  promoter (702)..(2115): Maize globulin promoter
  misc_recomb (2128)..(2284): attR1, complementary
  misc_feature (2471)..(3331)
  rep_origin (3452)..(4125): p-PUC ori
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggcccgagttaacgctaccatggagctccaaataatgattttattttgactgatagtgacctgttcgttgcaacaaattgataagcaatgcttttttataatgccaactttgtatagaaaagttgggtaccttaattaagcttcccgggccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgttttttctataaaaaaagggaaactgcccctcatttacagcaaattgtccgctgcctgtcgtccagatacaatgaacgtacctagtaggaactcttttacacgctcggtcgctcgccgcggatcggagtcccaggaacacgacaccactgtgtaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgctacctccgctttagttctgcatacagccaacccaaccgtcgacaccggtcaagtttgtacaaaaaagttgaacgagaaacgtaaaatgatataaatatcaatatattaaattagattttgcataaaaaacagactacataatactgtaaaacacaacatatgcagtcactatgaaccaactacttagatggtattagtgacctgtagaattcgagctctagagctgcagggcggccatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 51 - DNA, 4150 bp, Artificial sequence
  A Gateway entry vector contains rice chloroplast protein 12-like (Os.CP12) promoter  plus the first intron from metallothionin gene, which is flanked by recombination sites attL4 and attR1
  misc_recomb (592)..(688): attL4
  promoter (706)..(1559): rice chloroplast protein 12-like (Os.CP12) promoter
  Intron (1593)..(2175): 1sst intron of metallothionin gene
  misc_recomb (2191)..(2315): attR1
  misc_feature (2544)..(3353)
  rep_origin (3474)..(4147): pUC origin
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggcccgagttaacgctaccatggagctccaaataatgattttattttgactgatagtgacctgttcgttgcaacaaattgataagcaatgcttttttataatgccaactttgtatagaaaagttggctccgaattcgcccttgaattctcggcagggtggcagcatgggcctaaggcccagtcaactgtgggcctataagcgactaatccggctgtaactgggccttgcaagaggcttgtcttgttggtccgaactcaggaagtccaggttgcggggacaacttcaaggccatctggtttccacttctcttaccacctcaattccgctcttgatccgagctagcttagtcccaatctaaaaactttacaaagaaagaaccatacgcacctattgggcaaaatgaaaaataatttgctactcaccaaataatttgagcacctctgcacctgtacactaaataactctgttccaccaaaatagttgagatatctaggacgtttcattttgtccgttcttcaccaaacttttccatagtatctcagatattttcgagaccgaaagtgatctttctggccttagaccgagttcacttccctacaagccattctttgctggcacaacacgaacctctacatcaatttcgtatccaacctgaacttctgcatacatgtacacacccacagtcatctgctcatgttttcacggtcaaattaaaactgcttctctcaccttagattcacccaagggaaaagaaaaagatctcctttgccaagtccccatttcgcatgaaatatctcaaaatacagcccacgtggcacacgacgattggctgaggaggcgataagaaacgagtgcacgtcgtcgaatcctctctccccttctcccccaccccacggagctatatatatataaaccccatctcttcaatccgtgcaacgaacgcctcgtcgcaacagctacaaacgcccacatcacacgcagaaatccgcatcaacagagctcggtacccgggccttcacctgcggagggtaagatccgatcaccatcttctgaatttctgttcttgatctgtcatgtataataactgtctagtcttggtgttggtgagatggaaattcggtggatctcggaagggatattgttcgtttgctggggttttttttgtgtgttgtgatccgtagagaatttgtgtttatccatgttgttgatcttggtatgtattcatgacatattgacatgcatgtgttgtatgtgtcatatgtgtgcctctccttgggatttgttttggataatagaacatgttatggactcaatagtctgtgaacaaatctttttttagatggtggccaaatctgatgatgatctttcttgagaggaaaaagttcatgatagaaaaatcttttttgagatggtggcttaatgtgatgatgatctttcttgagaggaaaaaaaagattcattataggagattttgatttagctcctttccaccgatattaaatgaggagcatgcatgctgattgctgataaggatctgatttttttatcccctcttctttgaacagacaagaaataggctctgaatttctgattgattatttgtacatgcagaagggcgaattcgacccaagtttgtacaaaaaagttgaacgagaaacgtaaaatgatataaatatcaatatattaaattagattttgcataaaaaacagactacataatactgtaaaacacaacatatgcagtcactatgaaccaactacttagatggtattagtgacctgtagaattaattcgagctctagagctgcagggcggccgcgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 52 - DNA, 10874 bp, Artificial sequence
  This is a Gateway destination vector that contains the following components and flanked by recombination sites attL4 and attR1. Maize ubiquitin plus intron promoter, E. coli D-serine dehydratase [dsdA] as a selection marker and octopine synthase 3
  misc_recomb (47)..(171): attR4
  misc_feature (211)..(516)
  misc_feature (652)..(738)
  misc_feature (836)..(1516)
  misc_recomb (1624)..(1748): attR3, complementary
  repeat_unit (1815)..(1838): b-RB repeat
  rep_origin (4196)..(4877): ColE1
  misc_feature (5336)..(6151)
  misc_feature (5336)..(6151)
  misc_feature (6583)..(6710): b-LB[lm175]
  promoter (6744)..(8731): Maize Ubiquitin plus intron promoter
  misc_selection (8774)..(10102): E.coli D-serine dehydratase [dsdA] gene
  terminator (10140)..(10852): Octapine Synthase 3 terminator
cgcggccgtacaacgcgtaccggttaattaaattacgccaagctatcaactttgtatagaaaagttgaacgagaaacgtaaaatgatataaatatcaatatattaaattagattttgcataaaaaacagactacataatactgtaaaacacaacatatccagtcactatggtcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggggactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcggcaaaagagccgttcatttcaatgaaccgggcgacctcagccatcccttcctgattttccgctttccagcgttcggcacgcagacgacgggcttcattctgcatggttgtgcttaccgaaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatcctctagattacgccccgcctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacggatcctaactcaaaatccacatattatacgagccggaagcataaagtgtaaagcctggggtgcctaatgcggccgccatagtgactggatatgttgtgttttacagtattatgtagtctgttttttatgcaaaatctaatttaatatattgatatttatatcattttacgtttctcgttcaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaatt

SEQ ID NO: 53 - DNA, 11855 bp, Artificial sequence
  This is a binary vector constructed via multi-site Gateway cloning with following configuration: T-DNA left boder, Ubi promoter, Ocs terminater, attB4 site, ScBV promoter, attB1 site, maize ta-siRNA precursor, attB2 site, Nos terminator, T-DNA right
  misc_feature (47)..(71): Left T-DNA Border repeat region
  promoter (162)..(2149): Maize Ubiquitin plus intron promoter
  misc_selection (2192)..(3520): E.coli D-serine dehydratase [dsdA] gene
  terminator (3558)..(4270): Octapine Synthase 3 terminator
  misc_recomb (4339)..(4359): attB4
  promoter (4360)..(5782): promoter from sugarcane bacilliform virus (ScBV)
  misc_recomb (5783)..(5803): attB1
  prim_transcript (5819)..(6700): Maize ta-siRNA precursor initiated by miR390
  misc_feature (6359)..(6379): 5' D8 (+) phase, targeting maize ARF3 and ARF4
  misc_feature (6380)..(6400): 5' D7 (+) phase, Targeting maize ARF3 and ARF4
  misc_recomb (6715)..(6735): attB2
  terminator (6741)..(6993): NOS terminator
  misc_recomb (7001)..(7021): attB3
  misc_feature (7088)..(7111): Right T-DNA Border repeat region
  rep_origin (9469)..(10150): ColE1
  misc_feature (10609)..(11424)
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 54 - DNA, 11855 bp, Artificial sequence
  This is idetical to pRLM373 except 5'D7 (+) and 5'D8 (+) phases are replaced with DNA fragments targeting DsRed 2 gene
  misc_feature (6359)..(6379): Engineered 5' D8 (+) phase, 21-nt ta-siRNA targeting DsRed at position 342-362
  misc_feature (6380)..(6499): Engineered 5' D7 (+) phase, 21-nt ta-siRNA targeting DsRed at position 342-362
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgtagatgaagcagccgtccttgtagatgaagcagccgtcccactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 55 - DNA, 11855 bp, Artificial sequence
  This is idetical to pRLM373 except 5'D7 (+) and 5'D8 (+) phases are replaced with DNA fragments targeting DsRed 2 gene
  misc_feature (6359)..(6379): Engineered 5' D8 (+) phase, 21-nt ta-siRNA targeting DsRed at position 26-44.
  misc_feature (6380)..(6400): Engineered 5' D7 (+) phase, 21-nt ta-siRNA targeting DsRed at position 342-362
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgaagcgcatgaactcggtgttgtagatgaagcagccgtcccactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 56 - DNA, 11871 bp, Artificial sequence
  This is identical to pRLM373 except globulin 1 promoter is used to replace ScBV promoter
  promoter (4373)..(5786): Maize globulin-1 [p-Glb1] promoter
  promoter (4373)..(5786): Maize globulin-1 [p-Glb1] promoter
  misc_feature (6375)..(6395): 5' D8 (+) phase, targeting maize ARF3 and ARF4 genes
  misc_feature (6396)..(6416): 5' D7 (+) phase, targeting maize ARF3 and ARF4 genes.
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgggtaccttaattaagcttcccgggccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgttttttctataaaaaaagggaaactgcccctcatttacagcaaattgtccgctgcctgtcgtccagatacaatgaacgtacctagtaggaactcttttacacgctcggtcgctcgccgcggatcggagtcccaggaacacgacaccactgtgtaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgctacctccgctttagttctgcatacagccaacccaaccgtcgacaccggtcaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 57 - DNA, 11871 bp, Artificial sequence
  This is identical to pRLM374 except 5' D7 (+) and 5' D8 (+) phases are replaced by DNA fragments targeting DsRed 2 gene
  promoter (4373)..(5786): Maize globulin-1 [p-Glo1] promoter
  misc_feature (6375)..(6395): Engineered 5' D8 (+) phase, 21-nt ta-siRNA targeting DsRed at position 342-362.
  misc_feature (6396)..(6416): Engineered 5' D7 (+) phase, 21-nt ta-siRNA targeting DsRed at position 342-362.
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgggtaccttaattaagcttcccgggccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgttttttctataaaaaaagggaaactgcccctcatttacagcaaattgtccgctgcctgtcgtccagatacaatgaacgtacctagtaggaactcttttacacgctcggtcgctcgccgcggatcggagtcccaggaacacgacaccactgtgtaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgctacctccgctttagttctgcatacagccaacccaaccgtcgacaccggtcaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgtagatgaagcagccgtccttgtagatgaagcagccgtcccactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 58 - DNA, 11871 bp, Artificial sequence
  This is identical to pRLM377 except 5' D7 (+) and 5' D8 (+) phases are replaced by DNA fragments targeting DsRed 2 gene
  promoter (4373)..(5786): Maize globulin-1 [p-Glo1] promoter
  misc_feature (6375)..(6395): Engineered 5' D8 (+) phase, 21-nt ta-siRNA targeting DsRed at position 26-44.
  misc_feature (6396)..(6416): Engineered 5' D7 (+) phase, 21-nt ta-siRNA targeting DsRed at position 342-362.
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgggtaccttaattaagcttcccgggccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgttttttctataaaaaaagggaaactgcccctcatttacagcaaattgtccgctgcctgtcgtccagatacaatgaacgtacctagtaggaactcttttacacgctcggtcgctcgccgcggatcggagtcccaggaacacgacaccactgtgtaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgctacctccgctttagttctgcatacagccaacccaaccgtcgacaccggtcaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgaagcgcatgaactcggtgttgtagatgaagcagccgtcccactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 59 - DNA, 11935 bp, Artificial sequence
  This is identical to pRLM373 except Os CP12 promoter with rice metallothionin intron 1 are used to replace ScBV promoter
  promoter (4377)..(5230): Os CP12 promoter
  Intron (5264)..(5846): Rice Met-1 intron 1
  misc_feature (6439)..(6459): 5' D8 (+) phase, targeting maize endogenous ARF3 and ARF4
  misc_feature (6460)..(6480): 5' D7 (+) phase, targeting maize endogenous ARF3 and ARF4
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttggctccgaattcgcccttgaattctcggcagggtggcagcatgggcctaaggcccagtcaactgtgggcctataagcgactaatccggctgtaactgggccttgcaagaggcttgtcttgttggtccgaactcaggaagtccaggttgcggggacaacttcaaggccatctggtttccacttctcttaccacctcaattccgctcttgatccgagctagcttagtcccaatctaaaaactttacaaagaaagaaccatacgcacctattgggcaaaatgaaaaataatttgctactcaccaaataatttgagcacctctgcacctgtacactaaataactctgttccaccaaaatagttgagatatctaggacgtttcattttgtccgttcttcaccaaacttttccatagtatctcagatattttcgagaccgaaagtgatctttctggccttagaccgagttcacttccctacaagccattctttgctggcacaacacgaacctctacatcaatttcgtatccaacctgaacttctgcatacatgtacacacccacagtcatctgctcatgttttcacggtcaaattaaaactgcttctctcaccttagattcacccaagggaaaagaaaaagatctcctttgccaagtccccatttcgcatgaaatatctcaaaatacagcccacgtggcacacgacgattggctgaggaggcgataagaaacgagtgcacgtcgtcgaatcctctctccccttctcccccaccccacggagctatatatatataaaccccatctcttcaatccgtgcaacgaacgcctcgtcgcaacagctacaaacgcccacatcacacgcagaaatccgcatcaacagagctcggtacccgggccttcacctgcggagggtaagatccgatcaccatcttctgaatttctgttcttgatctgtcatgtataataactgtctagtcttggtgttggtgagatggaaattcggtggatctcggaagggatattgttcgtttgctggggttttttttgtgtgttgtgatccgtagagaatttgtgtttatccatgttgttgatcttggtatgtattcatgacatattgacatgcatgtgttgtatgtgtcatatgtgtgcctctccttgggatttgttttggataatagaacatgttatggactcaatagtctgtgaacaaatctttttttagatggtggccaaatctgatgatgatctttcttgagaggaaaaagttcatgatagaaaaatcttttttgagatggtggcttaatgtgatgatgatctttcttgagaggaaaaaaaagattcattataggagattttgatttagctcctttccaccgatattaaatgaggagcatgcatgctgattgctgataaggatctgatttttttatcccctcttctttgaacagacaagaaataggctctgaatttctgattgattatttgtacatgcagaagggcgaattcgacccaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 60 - DNA, 11935 bp, Artificial sequence
  This is identical to pRLM375 except 5' D7 (+) and 5' D8 (+) phases are replaced by DNA fragments targeting DsRed 2 gene
  promoter (4377)..(5230): Os CP12 promoter
  Intron (5264)..(5846): Rice Met-1 intron
  misc_feature (6439)..(6459): Engineered 5' D8 (+) phase, 21-nt ta-siRNA targeting DsRed at position 342-362
  misc_feature (6460)..(6480): Engineered 5' D7 (+) phase, 21-nt ta-siRNA targeting DsRed at position 342-362
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttggctccgaattcgcccttgaattctcggcagggtggcagcatgggcctaaggcccagtcaactgtgggcctataagcgactaatccggctgtaactgggccttgcaagaggcttgtcttgttggtccgaactcaggaagtccaggttgcggggacaacttcaaggccatctggtttccacttctcttaccacctcaattccgctcttgatccgagctagcttagtcccaatctaaaaactttacaaagaaagaaccatacgcacctattgggcaaaatgaaaaataatttgctactcaccaaataatttgagcacctctgcacctgtacactaaataactctgttccaccaaaatagttgagatatctaggacgtttcattttgtccgttcttcaccaaacttttccatagtatctcagatattttcgagaccgaaagtgatctttctggccttagaccgagttcacttccctacaagccattctttgctggcacaacacgaacctctacatcaatttcgtatccaacctgaacttctgcatacatgtacacacccacagtcatctgctcatgttttcacggtcaaattaaaactgcttctctcaccttagattcacccaagggaaaagaaaaagatctcctttgccaagtccccatttcgcatgaaatatctcaaaatacagcccacgtggcacacgacgattggctgaggaggcgataagaaacgagtgcacgtcgtcgaatcctctctccccttctcccccaccccacggagctatatatatataaaccccatctcttcaatccgtgcaacgaacgcctcgtcgcaacagctacaaacgcccacatcacacgcagaaatccgcatcaacagagctcggtacccgggccttcacctgcggagggtaagatccgatcaccatcttctgaatttctgttcttgatctgtcatgtataataactgtctagtcttggtgttggtgagatggaaattcggtggatctcggaagggatattgttcgtttgctggggttttttttgtgtgttgtgatccgtagagaatttgtgtttatccatgttgttgatcttggtatgtattcatgacatattgacatgcatgtgttgtatgtgtcatatgtgtgcctctccttgggatttgttttggataatagaacatgttatggactcaatagtctgtgaacaaatctttttttagatggtggccaaatctgatgatgatctttcttgagaggaaaaagttcatgatagaaaaatcttttttgagatggtggcttaatgtgatgatgatctttcttgagaggaaaaaaaagattcattataggagattttgatttagctcctttccaccgatattaaatgaggagcatgcatgctgattgctgataaggatctgatttttttatcccctcttctttgaacagacaagaaataggctctgaatttctgattgattatttgtacatgcagaagggcgaattcgacccaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgtagatgaagcagccgtccttgtagatgaagcagccgtcccactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 61 - DNA, 11935 bp, Artificial sequence
  This is identical to pRLM375 except 5' D7 (+) and 5' D8 (+) phases are replaced by DNA fragments targeting DsRed 2 gene
  promoter (4377)..(5230): Os CP12 promoter
  Intron (5264)..(5846): Rice Met-1 intron
  misc_feature (6439)..(6459): Engineered 5' D8 (+) phase, 21-nt ta-siRNA targeting DsRed at position 26-44.
  misc_feature (6460)..(6480): Engineered 5' D7 (+) phase, 21-nt ta-siRNA targeting DsRed at position 342-362.
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttggctccgaattcgcccttgaattctcggcagggtggcagcatgggcctaaggcccagtcaactgtgggcctataagcgactaatccggctgtaactgggccttgcaagaggcttgtcttgttggtccgaactcaggaagtccaggttgcggggacaacttcaaggccatctggtttccacttctcttaccacctcaattccgctcttgatccgagctagcttagtcccaatctaaaaactttacaaagaaagaaccatacgcacctattgggcaaaatgaaaaataatttgctactcaccaaataatttgagcacctctgcacctgtacactaaataactctgttccaccaaaatagttgagatatctaggacgtttcattttgtccgttcttcaccaaacttttccatagtatctcagatattttcgagaccgaaagtgatctttctggccttagaccgagttcacttccctacaagccattctttgctggcacaacacgaacctctacatcaatttcgtatccaacctgaacttctgcatacatgtacacacccacagtcatctgctcatgttttcacggtcaaattaaaactgcttctctcaccttagattcacccaagggaaaagaaaaagatctcctttgccaagtccccatttcgcatgaaatatctcaaaatacagcccacgtggcacacgacgattggctgaggaggcgataagaaacgagtgcacgtcgtcgaatcctctctccccttctcccccaccccacggagctatatatatataaaccccatctcttcaatccgtgcaacgaacgcctcgtcgcaacagctacaaacgcccacatcacacgcagaaatccgcatcaacagagctcggtacccgggccttcacctgcggagggtaagatccgatcaccatcttctgaatttctgttcttgatctgtcatgtataataactgtctagtcttggtgttggtgagatggaaattcggtggatctcggaagggatattgttcgtttgctggggttttttttgtgtgttgtgatccgtagagaatttgtgtttatccatgttgttgatcttggtatgtattcatgacatattgacatgcatgtgttgtatgtgtcatatgtgtgcctctccttgggatttgttttggataatagaacatgttatggactcaatagtctgtgaacaaatctttttttagatggtggccaaatctgatgatgatctttcttgagaggaaaaagttcatgatagaaaaatcttttttgagatggtggcttaatgtgatgatgatctttcttgagaggaaaaaaaagattcattataggagattttgatttagctcctttccaccgatattaaatgaggagcatgcatgctgattgctgataaggatctgatttttttatcccctcttctttgaacagacaagaaataggctctgaatttctgattgattatttgtacatgcagaagggcgaattcgacccaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgaagcgcatgaactcggtgttgtagatgaagcagccgtcccactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 62 - DNA, 245 bp, Artificial sequence
  XbaI - PstI fragment of maize ta-siRNA primary transcrip contains engineered 5' D7 (+) and 5' D8 (+) phases targeting maize phytoene desaturase
  misc_feature (27)..(47): Engineered 5' D8 (+) phase, tageting maize phytoene desaturase.
  misc_feature (48)..(68): Engineered 5' D7 (+) phase, tageting maize phytoene desaturase.
tctagattctcataccagaattaacgtagatagaaaccttcgataggttcacggcaaagcttgtatagcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtacc

SEQ ID NO: 63 - DNA, 21 bp, Zea mays
  misc_feature (1)..(21): Engineered 5' D8 (+) phase targeting maize phytoene desaturase
tagatagaaaccttcgatagg

SEQ ID NO: 64 - DNA, 21 bp, Zea mays
  misc_feature (1)..(21): Engineered 5' D7 (+) phase targeting maize phytoene desaturase
ttcacggcaaagcttgtatag

SEQ ID NO: 65 - DNA, 4298 bp, Artificial sequence
  This is identical to pRPR57 except 5' D7 (+) and 5' D8 (+) phases are replaced by DNA fragments targeting maize phytoene desaturase
  misc_feature (932)..(952): Engineered 5' D8 (+) phase, targeting maize phytoene desaturase at position 1585-1605.
  misc_feature (953)..(973): Engineered 5' D7 (+) phase, targeting maize phytoene desaturase at position 47-67.
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggttcacggcaaagcttgtatagcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 66 - DNA, 11855 bp, Artificial sequence
  This is identical to pRLM373 except 5' D7 (+) and 5' D8 (+) phases are replaced by a DNA fragment targeting maize phytoene desaturase mRNA
  promoter (4360)..(5782): Promoter from sugarcane bacilliform virus
  misc_feature (6359)..(6379): Engineered 5' D8 (+) phase, targeting maize phytoene desaturase at position 1585-1605.
  misc_feature (6380)..(6400): Engineered 5' D7 (+) phase, targeting maize phytoene desaturase at position 47-67
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggttcacggcaaagcttgtatagcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 67 - DNA, 11935 bp, Artificial sequence
  This is identical to pRLM375 except 5' D7 (+) and 5' D8 (+) phases are replaced by a DNA fragment targeting maize phytoene desaturase
  promoter (4377)..(5230): Os CP12 promoter
  Intron (5264)..(5846): Rice Met-1 intron
  misc_feature (6439)..(6459): Engineered 5' D7 (+) phase, targeting maize phytoene desaturase mRNA at position 1585-1605.
  misc_feature (6460)..(6480): Engineered 5' D7 (+) phase, targeting maize phytoene desaturase mRNA at position 47-67
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttggctccgaattcgcccttgaattctcggcagggtggcagcatgggcctaaggcccagtcaactgtgggcctataagcgactaatccggctgtaactgggccttgcaagaggcttgtcttgttggtccgaactcaggaagtccaggttgcggggacaacttcaaggccatctggtttccacttctcttaccacctcaattccgctcttgatccgagctagcttagtcccaatctaaaaactttacaaagaaagaaccatacgcacctattgggcaaaatgaaaaataatttgctactcaccaaataatttgagcacctctgcacctgtacactaaataactctgttccaccaaaatagttgagatatctaggacgtttcattttgtccgttcttcaccaaacttttccatagtatctcagatattttcgagaccgaaagtgatctttctggccttagaccgagttcacttccctacaagccattctttgctggcacaacacgaacctctacatcaatttcgtatccaacctgaacttctgcatacatgtacacacccacagtcatctgctcatgttttcacggtcaaattaaaactgcttctctcaccttagattcacccaagggaaaagaaaaagatctcctttgccaagtccccatttcgcatgaaatatctcaaaatacagcccacgtggcacacgacgattggctgaggaggcgataagaaacgagtgcacgtcgtcgaatcctctctccccttctcccccaccccacggagctatatatatataaaccccatctcttcaatccgtgcaacgaacgcctcgtcgcaacagctacaaacgcccacatcacacgcagaaatccgcatcaacagagctcggtacccgggccttcacctgcggagggtaagatccgatcaccatcttctgaatttctgttcttgatctgtcatgtataataactgtctagtcttggtgttggtgagatggaaattcggtggatctcggaagggatattgttcgtttgctggggttttttttgtgtgttgtgatccgtagagaatttgtgtttatccatgttgttgatcttggtatgtattcatgacatattgacatgcatgtgttgtatgtgtcatatgtgtgcctctccttgggatttgttttggataatagaacatgttatggactcaatagtctgtgaacaaatctttttttagatggtggccaaatctgatgatgatctttcttgagaggaaaaagttcatgatagaaaaatcttttttgagatggtggcttaatgtgatgatgatctttcttgagaggaaaaaaaagattcattataggagattttgatttagctcctttccaccgatattaaatgaggagcatgcatgctgattgctgataaggatctgatttttttatcccctcttctttgaacagacaagaaataggctctgaatttctgattgattatttgtacatgcagaagggcgaattcgacccaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggttcacggcaaagcttgtatagcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 68 - DNA, 245 bp, Artificial sequence
  A DNA fragment contains engineered 5' D7 (+) and 5' D8 (+) phases plus engineered miR166 binding site
  misc_feature (27)..(47): 5' D8 (+) phase targeting DsRed 2 gene
  misc_feature (48)..(68): 5' D7 (+) phase targeting DsRed 2 gene
  misc_binding (184)..(204): Engineered miR166 binding site to replace native miR390 binding site
tctagattctcataccagaattaacgttgtagatgaagcagccgtccttgtagatgaagcagccgtcccactctgtgtctgcatccttctcgcatcccttgtttccttctttcccactacatgcaggatcagtcccgatattgccgtgtttgccagccttctgcatccacctactttctgttcggggaatgaagcctggtccgaattgttgctcctatgtaatccgtgtttattatttcggtacc

SEQ ID NO: 69 - DNA, 21 bp, Artificial sequence
  Complementary to maize miR166
  misc_binding (1)..(21): maize miR166 binding site
ggggaatgaagcctggtccga

SEQ ID NO: 70 - RNA, 21 nt, Zea mays
  misc_RNA (1)..(21): maize miR166
ucggaccaggcuucauucccc

SEQ ID NO: 71 - DNA, 4298 bp, Artificial sequence
  This is identicalo to pRP58 except miR390 binding site is replaced by miR166 binding site
  misc_feature (932)..(952): Engineered 5' D8 (+) phase targeting DsRed 2 gene
  misc_feature (953)..(973): Engineered 5' D7 (+) phase targeting DsRed 2 gene
  misc_binding (1089)..(1109): Native miR390 binding site replaced by miR166 binding site
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgccagccttctgcatccacctactttctgttcggggaatgaagcctggtccgaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 72 - DNA, 245 bp, Artificial sequence
  A DNA fragment contains engineered 5' D7 (+) and 5' D8 (+) phases plus engineered miR166 binding site
  misc_feature (27)..(47): Engineered 5' D8 (+) phase targeting DsRed 2 gene
  misc_feature (48)..(68): Engineered 5' D7 (+) phase targeting DsRed 2 gene
  Engineered miR167 binding site (183)..(204): Native miR390 binding site replaced by miR167 binding site
tctagattctcataccagaattaacgttgaagcgcatgaactcggtgttgtagatgaagcagccgtcccactctgtgtctgcatccttctcgcatcccttgtttccttctttcccactacatgcaggatcagtcccgatattgccgtgtttgccagccttctgcatccacctactttctgttacagatcatgctggcagcttcaattgttgctcctatgtaatccgtgtttattatttcggtacc

SEQ ID NO: 73 - DNA, 22 bp, Artificial sequence
  Complementary to Zm miR167
  misc_binding (1)..(22): maize miR167 binding site
acagatcatgctggcagcttca

SEQ ID NO: 74 - RNA, 22 nt, Zea mays
  misc_RNA (1)..(22): maize miR167
ugaagcugccagcaugaucugu

SEQ ID NO: 75 - DNA, 4319 bp, Artificial sequence
  This is identical to pRPR36 except miR166 binding site replaced by niR167 binding site
  misc_feature (932)..(952): Engineered 5' D8 (+) phase targeting DsRed 2 gene
  misc_feature (953)..(973): Engineered 5' D7 (+) phase targeting DsRed 2 gene
  misc_binding (1088)..(1109): Native miR390 binding site replaced by miR167 binding site
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgccagccttctgcatccacctactttctgttacagatcatgctggcagcttcaggggaatgaagcctggtccgaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 76 - DNA, 11855 bp, Artificial sequence
  This is identical to pRLM376 except miR390 binding site is replaced by miR166 binding site
  misc_feature (6359)..(7379): Engineered 5' D8 (+) phase targeting DsRed 2 gene
  misc_feature (6380)..(6400): Engineered 5' D7 (+) phase targeting DsRed 2 gene
  misc_binding (6516)..(6536): Native miR390 binding site replaced by miR166
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgtagatgaagcagccgtccttgtagatgaagcagccgtcccactctgtgtctgcatccttctcgcatcccttgtttccttctttcccactacatgcaggatcagtcccgatattgccgtgtttgccagccttctgcatccacctactttctgttcggggaatgaagcctggtccgaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 77 - DNA, 11856 bp, Artificial sequence
  This is identical to pRLM376 except miR390 binding site replaced by miR167 binding site
  misc_feature (6359)..(6379): Engineered 5' D7 (+) phase targeting DsRed 2 gene
  misc_feature (6380)..(6400): Engineered 5' D7 (+) phase targeting DsRed 2 gene
  misc_binding (6516)..(6537): Native miR390 binding site replaced by miR167 binding site
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttgtagatgaagcagccgtccttgtagatgaagcagccgtcccactctgtgtctgcatccttctcgcatcccttgtttccttctttcccactacatgcaggatcagtcccgatattgccgtgtttgccagccttctgcatccacctactttctgttcacagatcatgctggcagcttcaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 78 - RNA, 17 nt, Arabidopsis thaliana
  misc_RNA (1)..(17): small RNA
aacaucggggcaagacc

SEQ ID NO: 79 - RNA, 17 nt, Arabidopsis thaliana
  misc_RNA (1)..(17): small RNA
uucuuuguccguugcua

SEQ ID NO: 80 - RNA, 17 nt, Arabidopsis thaliana
  misc_RNA (1)..(17): small RNA
ugcucaccucucuuucu

SEQ ID NO: 81 - DNA, 21 bp, Artificial sequence
  Engineered binding site of sm18 in ta-siRNA primary transcript
  misc_binding (1)..(21): sm 18 binding site to replace miR173 or miR390 binding site in ta-siRNA primary transcripts
gagcggtcttgccccgatgtt

SEQ ID NO: 82 - DNA, 21 bp, Artificial sequence
  Engineered binding site of sm19 in ta-siRNA primary transcript
  misc_binding (1)..(21): sm 19 binding site to replace miR173 or miR390 binding site in ta-siRNA primary transcripts
accatagcaacggacaaagaa

SEQ ID NO: 83 - DNA, 21 bp, Artificial sequence
  Engineered binding site of sm14 in ta-siRNA primary transcript
  misc_binding (1)..(21): sm 14 binding site to replace miR173 or miR390 binding site in ta-siRNA primary transcripts
tgacagaaagagaggtgagca

SEQ ID NO: 84 - RNA, 21 nt, Arabidopsis thaliana
ugccuggcucccuguaugcca

SEQ ID NO: 85 - RNA, 24 nt, Arabidopsis thaliana
uugaagaggacuuggaacuucgau

SEQ ID NO: 86 - RNA, 21 nt, Arabidopsis thaliana
ugaagcugccagcaugaucua

SEQ ID NO: 87 - RNA, 21 nt, Arabidopsis thaliana
agaaucuugaugaugcugcau

SEQ ID NO: 88 - RNA, 20 nt, Arabidopsis thaliana
uuggacugaagggagcuccc

SEQ ID NO: 89 - RNA, 21 nt, Oryza sativa
ugacagaagagagugagcaca

SEQ ID NO: 90 - RNA, 21 nt, Oryza sativa
cgacagaagagagugagcaua

SEQ ID NO: 91 - RNA, 21 nt, Oryza sativa
uuuggauugaagggagcucug

SEQ ID NO: 92 - RNA, 21 nt, Oryza sativa
ugccuggcucccugaaugcca

SEQ ID NO: 93 - RNA, 21 nt, Oryza sativa
ucgauaaaccucugcauccag

SEQ ID NO: 94 - RNA, 21 nt, Oryza sativa
uggagaagcagggcacgugca

SEQ ID NO: 95 - RNA, 21 nt, Oryza sativa
uggagaagcagggcacgugcu

SEQ ID NO: 96 - RNA, 21 nt, Oryza sativa
ucggaccaggcuucauucccc

SEQ ID NO: 97 - RNA, 21 nt, Oryza sativa
ugaagcugccagcaugaucug

SEQ ID NO: 98 - RNA, 21 nt, Oryza sativa
ucgcuuggugcagaucgggac

SEQ ID NO: 99 - RNA, 21 nt, Oryza sativa
uagccaaggaugacuugccua

SEQ ID NO: 100 - RNA, 21 nt, Oryza sativa
uagccaaggaugacuugccug

SEQ ID NO: 101 - RNA, 21 nt, Oryza sativa
ugauugagccgugccaauauc

SEQ ID NO: 102 - RNA, 21 nt, Oryza sativa
uuauugagugcagcguugaug

SEQ ID NO: 103 - RNA, 21 nt, Oryza sativa
uguguucucaggucaccccuu

SEQ ID NO: 104 - RNA, 21 nt, Oryza sativa
ugccaaaggaaauuugccccg

SEQ ID NO: 105 - RNA, 20 nt, Zea mays
ugacagaagagagugagcac

SEQ ID NO: 106 - RNA, 21 nt, Zea mays
uuuggauugaagggagcucua

SEQ ID NO: 107 - RNA, 21 nt, Zea mays
ugccuggcucccuguaugcca

SEQ ID NO: 108 - RNA, 21 nt, Zea mays
ucggaccaggcuucauucccc

SEQ ID NO: 109 - RNA, 22 nt, Zea mays
ugaagcugccagcaugaucugg

SEQ ID NO: 110 - RNA, 21 nt, Zea mays
ugauugagccgcgccaauauc

SEQ ID NO: 111 - DNA, 12587 bp, Artificial sequence
  RLM 185:  a binary vector to express dsRed in maize
  repeat_region (42)..(66): b-LB_repeat
  promoter (157)..(2144): Maize Ubiquitin plus intron promoter
  CDS (2178)..(4094): ZmAHAS L2 S653(At)N (XI12) cds
  terminator (4095)..(5310): Maize AHASL2 [XI12] 3'/UTR sequence with terminator
  promoter (5368)..(6765): Sugarcane bacilliform virus [ScBV] promoter; 100% homology to #SBVORFS Sugarcane bacilliform virus.
  CDS (6784)..(7461): Discosoma sp. red fluorescent protein [drFP583;1], human optimized, from Clontech. Mutations [R2A, K5E, K9T prevent aggregation] & [A105V, I161T, S197A rapid maturation]
  terminator (7493)..(7745): Nopaline Synthase poly-A terminator.
  repeat_region (7775)..(7919): b-RB[lm175]
tttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatccactagttctagaaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgatccccgcaagggcgccgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgcggcctccggctacgcgcgctcctcgggccgcgtcggcgtctgcatcgccacctccggccccggcgccaccaaccttgtctccgcgctcgccgacgcgctgctcgattccgtccccatggtcgccatcacgggacaggtgccgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccggggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcccggcgccctgttctttatgttggcggtggctgcgcagcatctggtgaggagttgcgacgctttgtggagctgactggaatcccggtcacaactactcttatgggcctcggcaacttccccagcgacgacccactgtctctgcgcatgctaggtatgcatggcacggtgtatgcaaattatgcagtggataaggccgatctgttgcttgcacttggtgtgcggtttgatgatcgtgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggccaacccaggtgttactgttgttgacatcgatggagatggtagctttctcatgaacgttcaggagctagctatgatccgaattgagaacctcccggtgaaggtctttgtgctaaacaaccagcacctggggatggtggtgcagtgggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctaatggtggggctttcaaggatatgatcctggatggtgatggcaggactgtgtactgatctaaaatccagcaagcaactgatctaaaatccagcaagcaccgcctccctgctagtacaagggtgatatgtttttatctgtgtgatgttctcctgtattctatctttttttgtaggccgtcagctatctgttatggtaatcctatgtagcttccgaccttgtaattgtgtagtctgttgttttccttctggcatgtgtcataagagatcatttaagtgccttttgctacatataaataagataataagcactgctatgcagtggttctgaattggcttctgttgccaaatttaagtgtccaactggtccttgcttttgttttcgctatttttttccttttttagttattattatattggtaatttcaactcaacatatgatgtatggaataatgctagggctgcaatttcaaactattttacaaaccagaatggcattttcgtggtttgaggggagtgaaaaaaaatgaggcatttgactgaattagttacctgatccattttcgtggtttggatcattggaattaaattccattctaataatagtaattttggcatatatcaattaagttaattcggttttatgcaaaatatatttgtatactattattatcaagatgtcggagatatttatatgctacatttttactatacaggagtgagatgaagagtgtcatgtaagttacacagtagaaacaaattctattaatgcataaaatcatttccatcatccaccctatgaatttgagatagacctatatctaaactttgaaaagtggttgaatatcaaattccaaattaaataagttattttattgagtgaattctaatttctctaaaacgaagggatctaaacgccctctaaagctaatttggaaactcaaactttcttagcattggaggggattgagaaaaaatattaattcattttcatctcaatcattcaatctccaaagagatttgagttccttattagtctgttccatgcatcaaatcggctcaatgtgtcattatttgccatgacgattgacgagttgttctggggcctagcgctttccacgccgatgtgctggggcctggtcctggagaagacagcttgatatttaaagctatcaattgtttcaattgattcccacttcatttttctaaatgtagaaaacggtgacgtataagaaaaagaatgaattaggacttttattccgtacactaatctagagcggccgcaagcttgtacaacgcgtaccggttaattaaggtacccaattgcatatgtaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccaagggggtaccggtcgccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggccgccctgcagggagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgggcccggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgat

SEQ ID NO: 112 - protein, 638 aa, Artificial sequence
  Synthetic Construct
MATAAAASTALTGATTAAPKARRRAHLLATRRALAAPIRCSAASPAMPMAPPATPLRPWGPTDPRKGADILVESLERCGVRDVFAYPGGASMEIHQALTRSPVIANHLFRHEQGEAFAASGYARSSGRVGVCIATSGPGATNLVSALADALLDSVPMVAITGQVPRRMIGTDAFQETPIVEVTRSITKHNYLVLDVDDIPRVVQEAFFLASSGRPGPVLVDIPKDIQQQMAVPVWDKPMSLPGYIARLPKPPATELLEQVLRLVGESRRPVLYVGGGCAASGEELRRFVELTGIPVTTTLMGLGNFPSDDPLSLRMLGMHGTVYANYAVDKADLLLALGVRFDDRVTGKIEAFASRAKIVHVDIDPAEIGKNKQPHVSICADVKLALQGMNALLEGSTSKKSFDFGSWNDELDQQKREFPLGYKTSNEEIQPQYAIQVLDELTKGEAIIGTGVGQHQMWAAQYYTYKRPRQWLSSAGLGAMGFGLPAAAGASVANPGVTVVDIDGDGSFLMNVQELAMIRIENLPVKVFVLNNQHLGMVVQWEDRFYKANRAHTYLGNPENESEIYPDFVTIAKGFNIPAVRVTKKNEVRAAIKKMLETPGPYLLDIIVPHQEHVLPMIPNGGAFKDMILDGDGRTVY

SEQ ID NO: 113 - protein, 225 aa, Artificial sequence
  Synthetic Construct
MASSENVITEFMRFKVRMEGTVNGHEFEIEGEGEGRPYEGHNTVKLKVTKGGPLPFAWDILSPQFQYGSKVYVKHPADIPDYKKLSFPEGFKWERVMNFEDGGVATVTQDSSLQDGCFIYKVKFIGVNFPSDGPVMQKKTMGWEASTERLYPRDGVLKGETHKALKLKDGGHYLVEFKSIYMAKKPVQLPGYYYVDAKLDITSHNEDYTIVEQYERTEGRHHLFL

SEQ ID NO: 114 - DNA, 4298 bp, Artificial sequence
  RJM128:  entry vector for multi-site Gateway cloning
  misc_recomb (281)..(376): attL1
  prim_transcript (392)..(1273): miR390 precursor with 5' D2(+) phase replaced by 21-nt targeting maize phytoene desaturase
  misc_feature (1058)..(1078): 5' D2(+) phase replcase by 21-nt targeting PDS
  misc_feature (1089)..(1109): miR390 target site
  misc_recomb (1288)..(1383): attL2
tttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgtagatagaaaccttcgataggctttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattt

SEQ ID NO: 115 - DNA, 4298 bp, Artificial sequence
  RLM 129:  entry vector for multi-site Gateway cloing
  misc_recomb (281)..(376): attL1
  prim_transcript (392)..(1273): Maize miR390 precursor with 5' D2(+) phase replaced by 21-nt targeting maize phytoene desaturase
  prim_transcript (392)..(1273): Maize miR390 precursor with 5' D3(+) phase replaced by 21-nt targeting maize phytoene desaturase
  misc_feature (1037)..(1057): 5' D3(+) phase replcase by 21-nt targeting PDS
  misc_feature (1058)..(1078): 5' D3(+) phase replcase by 21-nt targeting PDS
  misc_feature (1089)..(109): miR390 target site
  misc_recomb (1288)..(1383): attL2
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcatagatagaaaccttcgataggccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 116 - DNA, 4298 bp, Artificial sequence
  RJM130:  entry vector for multi-site Gateway cloing
  misc_recomb (281)..(376): attL1
  prim_transcript (392)..(1273): Maize miR390 precursor with 5' D4 (+) phase replaced by 21-nt targeting maize phytoene desaturase
  misc_feature (1016)..(1036): 5' D4(+) phase replcase by 21-nt targeting PDS
  misc_feature (1089)..(1109): miR390 target site
  misc_recomb (1288)..(1383): attL2
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttcttagatagaaaccttcgatagggtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 117 - DNA, 4298 bp, Artificial sequence
  RJM131:  entry vector for multi-site Gateway cloing
  misc_recomb (281)..(376): attL1
  prim_transcript (392)..(1273): Maize miR390 precursor with 5' D5(+) phase replaced by 21-nt targeting maize phytoene desaturase
  misc_feature (995)..(1015): 5' D5(+) phase replcase by 21-nt targeting PDS
  misc_feature (1089)..(1109): miR390 target site
  misc_recomb (1288)..(1383): attL2
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctagatagaaaccttcgataggttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 118 - DNA, 4298 bp, Artificial sequence
  RJM132:  entry vector for multi-site Gateway cloing
  misc_recomb (281)..(376): attL1
  prim_transcript (392)..(1273): Maize miR390 precursor with 5' D6(+) phase replaced by 21-nt targeting maize phytoene desaturase
  misc_feature (974)..(994): 5' D6 (+) phase replcase by 21-nt targeting PDS
  misc_feature (1089)..(1109): miR390 target site
  misc_recomb (1288)..(1383): attL2
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctcttagatagaaaccttcgataggtcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 119 - DNA, 4298 bp, Artificial sequence
  RJM133:  entry vector for multi-site Gateway cloing
  misc_recomb (281)..(376): attL1
  prim_transcript (392)..(1273): Maize miR390 precursor with 5' D7 (+) phase replaced by 21-nt targeting maize phytoene desaturase
  misc_feature (953)..(973): 5' D7 (+) phase replcase by 21-nt targeting PDS
  misc_feature (1089)..(1109): miR390 target site
  misc_recomb (1288)..(1383): attL2
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctctagatagaaaccttcgataggcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 120 - DNA, 4298 bp, Artificial sequence
  RJM134: entry vector for multi-site Gateway cloing
  misc_recomb (281)..(376): attL1
  prim_transcript (392)..(1273): Maize miR390 precursor with 5' D8(+) phase replaced by 21-nt targeting maize phytoene desaturase
  misc_feature (932)..(952): 5' D8 (+) phase replcase by 21-nt targeting PDS
  misc_feature (1089)..(1109): miR390 target site
  misc_recomb (1288)..(1383): attL2
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggttcttgaccttgtaaggctctcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 121 - DNA, 4298 bp, Artificial sequence
  RJM135:  identical to pRPR57 except replacement of miR390 binding site with maize miR172 binding site and replacement of 5'D7(+) and 5'D8(+) phases with two 21-nt ta-siRNAs targeting maize phytoene desaturase
  misc_feature (932)..(952): 5'D8(+) phases replaced with an engineered ta-siRNAs targeting maize phytoene desaturase
  misc_feature (953)..(973): 5'D7(+) phases replaced with an engineered ta-siRNAs targeting maize phytoene desaturase
  misc_feature (1089)..(1109): miR172 binding site
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcctgcagcatcatcaggattccattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 122 - DNA, 4298 bp, Artificial sequence; identical to SEQ ID NO: 121
  RJM136:  identical to pRPR57 except replacement of miR390 binding site with maize miR172 binding site and replacement of 5'D7(+) and 5'D8(+) phases with two 21-nt ta-siRNAs targeting maize phytoene desaturase
  misc_feature (932)..(952): 5'D8(+) phases replaced with an engineered ta-siRNAs targeting maize phytoene desaturase
  misc_feature (953)..(973): 5'D7(+) phases replaced with an engineered ta-siRNAs targeting maize phytoene desaturase
  misc_feature (1089)..(1109): Maize miR390 binding site replaced with miR172 binding site

SEQ ID NO: 123 - DNA, 4298 bp, Artificial sequence
  RJM140:  identical to RJM135 except miR172 binding site replaced with miR156 binding site
  misc_feature (1089)..(1109): miR172 binding site replaced with miR156 binding site
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcgtgctctctctcttctgtcaaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 124 - DNA, 4298 bp, Artificial sequence; identical to SEQ ID NO: 123
  RJM141: identical to RJM135 except miR172 binding site replaced with miR159 binding site
  misc_feature (1089)..(1109): miR172 binding site replaced with miR159 binding site

SEQ ID NO: 125 - DNA, 4298 bp, Artificial sequence
  RJM142:  identical to RJM135 except miR172 binding site replaced with miR166 binding site
  misc_feature (1089)..(1109): miR390 binding site replaced with miR166 binding site
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcctgggatgaagcctggtccggattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 126 - DNA, 11855 bp, Artificial sequence
  RJM145:  identical to pRLM373 except 5'D2(+) phase replaced with an engineered ta-siRNA targeting maize phytoene desaturase
  misc_feature (11333)..(11353): 5'D2(+) phase replaced with an engineered ta-siRNA targeting maize phytoene desaturase
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgtagatagaaaccttcgataggctttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 127 - DNA, 11855 bp, Artificial sequence
  RJM146: identical to pRLM373 except 5'D3(+) phase replaced with an engineered ta-siRNA targeting maize phytoene desaturase
  misc_feature (11312)..(11332): 5'D3(+) phase replaced with an engineered ta-siRNA targeting maize phytoene desaturase
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttctttcccactacatgcaggatcatagatagaaaccttcgataggccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 128 - DNA, 11855 bp, Artificial sequence
  RJM147:  identical to pRLM373 except 5'D4(+) phase replaced with an engineered ta-siRNA targeting maize phytoene desaturase
  misc_feature (11292)..(11311): 5'D4(+) phase replaced with an engineered ta-siRNA targeting maize phytoene desaturase
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctcgcatcccttgtttccttcttagatagaaaccttcgatagggtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 129 - DNA, 11855 bp, Artificial sequence
  RJM148:  identical to pRLM373 except 5'D5(+) phase replaced with an engineered ta-siRNA targeting maize phytoene desaturase
  misc_feature (11270)..(11290): 5'D5(+) phase replaced with an engineered ta-siRNA targeting maize phytoene desaturase
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctctcactctgtgtctgcatccttctagatagaaaccttcgataggttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 130 - DNA, 11855 bp, Artificial sequence
  RJM149:  identical to pRLM373 except 5'D6(+) phase replaced with an engineered ta-siRNA targeting maize phytoene desaturase
  misc_feature (11249)..(11269): 5'D6(+) phase replaced with an engineered ta-siRNA targeting maize phytoene desaturase
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctcttcttgaccttgtaaggctcttagatagaaaccttcgataggtcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 131 - DNA, 11855 bp, Artificial sequence
  RJM150:  identical to pRLM373 except 5'D7(+) phase replaced with an engineered ta-siRNA targeting maize phytoene desaturase
  misc_feature (11228)..(11248): 5'D7(+) phase replaced with an engineered ta-siRNA targeting maize phytoene desaturase
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgttcttgaccttgtaaggcctctagatagaaaccttcgataggcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 132 - DNA, 11855 bp, Artificial sequence
  RJM151:  identical to pRLM373 except 5'D8(+) phase replaced with an engineered ta-siRNA targeting maize phytoene desaturase
  misc_feature (11207)..(11227): 5'D8(+) phase replaced with an engineered ta-siRNA targeting maize phytoene desaturase
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggttcttgaccttgtaaggctctcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 133 - DNA, 4298 bp, Artificial sequence
  RJM137:  identical to pRPR57 except the 147 bp 5'D2(+) through 5'D8(+) phases are replaced with a 147 bp fregment of maize phytoene desaturase
  misc_feature (932)..(1078)
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgcttcccggataggactgcaccttccatggaagccaggtatttctgctttgtgtaatcaccagctagatagaaaccttcgataggtgacctttggagaggccggcaaggctcacagtttgggacagttttgtaaaccgatctcggtgtctttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 134 - DNA, 11855 bp, Artificial sequence
  RJM154:  identical to pRLM373 except 5'D2(+) through 5'D8(+) phase replaced with a 147 bp fragment of maize phytoene desaturase
  misc_feature (11207)..(11353): 5'D2(+) through 5'D8(+) phase replaced with a 147 bp fragment of maize phytoene desaturase
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgcttcccggataggactgcaccttccatggaagccaggtatttctgctttgtgtaatcaccagctagatagaaaccttcgataggtgacctttggagaggccggcaaggctcacagtttgggacagttttgtaaaccgatctcggtgtctttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 135 - DNA, 11855 bp, Artificial sequence
  RJM153: identical to RLM424 except miR390 binding site replaced by miR172 binding site
  misc_feature (11364)..(11384): miR390 binding site replaced with miR172 binding site
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggttcacggcaaagcttgtatagcactctgtgtctgcatccttctcgcatcccttgtttccttctttcccactacatgcaggatcagtcccgatattgccgtgtttgccagccttctgcatccacctactttctgttcctgcagcatcatcaggattccattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 136 - DNA, 11855 bp, Artificial sequence
  RJM156:  identical to pRLM423 except miR390 binding site replaced with miR156 binding site
  misc_feature (11364)..(11384): miR390 binding site replaced with miR156 binding site
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcgtgctctctctcttctgtcaaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 137 - DNA, 11855 bp, Artificial sequence
  RJM157:  identical to pRLM423 except miR390 binding site replaced with miR159 binding site
  misc_feature (11364)..(11384): miR390 binding site replaced with miR159 binding site
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttctggagctcccttcactccaagattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 138 - DNA, 11855 bp, Artificial sequence
  RJM158:  identical to pRLM423 except miR390 binding site replaced by miR166 binding site
  misc_feature (11364)..(11384): miR390 binding site replaced with miR166 binding site
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcctgggatgaagcctggtccggattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 139 - DNA, 12885 bp, Artificial sequence
  RJM160:  similar to RJM156 except replacement of DsdA transformation selectable marker and NOS terminator with AHAS selectable marker plus Xi12 3'UTR
  CDS (7031)..(8947): Z.mays gene for acetohydroxyacid synthase (AHAS108) Large Subunit 2 version
  terminator (8946)..(10156): Maize AHASL2 [XI12] 3'/UTR sequence with terminator
  misc_feature (12237)..(12257): 5'D8(+) phase replaced with an engineered ta-siRNA targeting maize phytoene desaturase
  misc_feature (12258)..(12278): 5'D7(+) phase replaced with an engineered ta-siRNA targeting maize phytoene desaturase
  misc_feature (12394)..(12414): miR390 binding site replaced with miR156 binding site
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatccactagttctagaaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgatccccgcaagggcgccgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgcggcctccggctacgcgcgctcctcgggccgcgtcggcgtctgcatcgccacctccggccccggcgccaccaaccttgtctccgcgctcgccgacgcgctgctcgattccgtccccatggtcgccatcacgggacaggtgccgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccggggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcccggcgccctgttctttatgttggcggtggctgcgcagcatctggtgaggagttgcgacgctttgtggagctgactggaatcccggtcacaactactcttatgggcctcggcaacttccccagcgacgacccactgtctctgcgcatgctaggtatgcatggcacggtgtatgcaaattatgcagtggataaggccgatctgttgcttgcacttggtgtgcggtttgatgatcgtgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggccaacccaggtgttactgttgttgacatcgatggagatggtagctttctcatgaacgttcaggagctagctatgatccgaattgagaacctcccggtgaaggtctttgtgctaaacaaccagcacctggggatggtggtgcagtgggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctaatggtggggctttcaaggatatgatcctggatggtgatggcaggactgtgtactgatctaaaatccagcaagcaactgatctaaaatccagcaagcaccgcctccctgctagtacaagggtgatatgtttttatctgtgtgatgttctcctgtattctatctttttttgtaggccgtcagctatctgttatggtaatcctatgtagcttccgaccttgtaattgtgtagtctgttgttttccttctggcatgtgtcataagagatcatttaagtgccttttgctacatataaataagataataagcactgctatgcagtggttctgaattggcttctgttgccaaatttaagtgtccaactggtccttgcttttgttttcgctatttttttccttttttagttattattatattggtaatttcaactcaacatatgatgtatggaataatgctagggctgcaatttcaaactattttacaaaccagaatggcattttcgtggtttgaggggagtgaaaaaaaatgaggcatttgactgaattagttacctgatccattttcgtggtttggatcattggaattaaattccattctaataatagtaattttggcatatatcaattaagttaattcggttttatgcaaaatatatttgtatactattattatcaagatgtcggagatatttatatgctacatttttactatacaggagtgagatgaagagtgtcatgtaagttacacagtagaaacaaattctattaatgcataaaatcatttccatcatccaccctatgaatttgagatagacctatatctaaactttgaaaagtggttgaatatcaaattccaaattaaataagttattttattgagtgaattctaatttctctaaaacgaagggatctaaacgccctctaaagctaatttggaaactcaaactttcttagcattggaggggattgagaaaaaatattaattcattttcatctcaatcattcaatctccaaagagatttgagttccttattagtctgttccatgcatcaaatcggctcaatgtgtcattatttgccatgacgattgacgagttgttctggggcctagcgctttccacgccgatgtgctggggcctggtcctggagaagacagcttgatatttaaagctatcaattgtttcaattgattcccacttcatttttctaaatgtagaaaacggtgacgtataagaaaaagaatgaattaggacttttattccgtacactaatctagagcggccgcaagcttgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcgtgctctctctcttctgtcaaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 140 - protein, 638 aa, Artificial sequence; identical to SEQ ID NO: 112
  Synthetic Construct

SEQ ID NO: 141 - DNA, 4298 bp, Artificial sequence
  pRPR21:  entry vector containing maize miR390 ta-siRNA precursor with native 5'D7(+) and 5'D8(+) phases replaced by 21-nt sequence targeting maize phytoene desaturase
  misc_feature (932)..(952): 5'D8(+) phase replaced with 21-nt targeting maize phytoene desaturase
  misc_feature (953)..(973): 5'D7(+) phase replaced with 21-nt targeting maize phytoene desaturase
agcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctccttcctcttccagcccttcctctttcgggccccaaataatgattttattttgactgatagtgacctgttcgttgcaacaaattgatgagcaatgcttttttataatgccaactttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagttggcattataagaaagcattgcttatcaatttgttgcaacgaacaggtcactatcagtcaaaataaaatcattatttgccatccagctgatatcgaaagtcctctccactgactgtagcctccaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagga

SEQ ID NO: 142 - DNA, 11855 bp, Artificial sequence
  pRLM423:  this is identical to pRLM424 except that both 5' D7 (+) and 5' D8 (+) phases are replaced by a DNA fragment PDS-3 targeting maize phytoene desaturase mRNA
  misc_feature (6359)..(6379): Native 5'D8(+) phase replaced by 21-nt PDS-3 targeting maize PDS at position 1585-1605
  misc_feature (6380)..(6400): Native 5'D7(+) phase replaced by 21-nt PDS-3 targeting maize PDS at position 1585-1605
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 143 - DNA, 11935 bp, Artificial sequence
  pRLM427:  this is identical to pRLM428 except that 5' D7 (+) and 5' D8 (+) phases are replaced by a DNA fragment targeting maize phytoene desaturase mRNA.
  prim_transcript (5899)..(6780): maize miR390 primary transcript
  misc_feature (6439)..(6459): Native 5'D8(+) phase replaced by 21-nt PDS-3 targeting maize PDS at position 1585-1605
  misc_feature (6460)..(6480): Native 5'D7(+) phase replaced by 21-nt PDS-3 targeting maize PDS at position 1585-1605
gtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttggctccgaattcgcccttgaattctcggcagggtggcagcatgggcctaaggcccagtcaactgtgggcctataagcgactaatccggctgtaactgggccttgcaagaggcttgtcttgttggtccgaactcaggaagtccaggttgcggggacaacttcaaggccatctggtttccacttctcttaccacctcaattccgctcttgatccgagctagcttagtcccaatctaaaaactttacaaagaaagaaccatacgcacctattgggcaaaatgaaaaataatttgctactcaccaaataatttgagcacctctgcacctgtacactaaataactctgttccaccaaaatagttgagatatctaggacgtttcattttgtccgttcttcaccaaacttttccatagtatctcagatattttcgagaccgaaagtgatctttctggccttagaccgagttcacttccctacaagccattctttgctggcacaacacgaacctctacatcaatttcgtatccaacctgaacttctgcatacatgtacacacccacagtcatctgctcatgttttcacggtcaaattaaaactgcttctctcaccttagattcacccaagggaaaagaaaaagatctcctttgccaagtccccatttcgcatgaaatatctcaaaatacagcccacgtggcacacgacgattggctgaggaggcgataagaaacgagtgcacgtcgtcgaatcctctctccccttctcccccaccccacggagctatatatatataaaccccatctcttcaatccgtgcaacgaacgcctcgtcgcaacagctacaaacgcccacatcacacgcagaaatccgcatcaacagagctcggtacccgggccttcacctgcggagggtaagatccgatcaccatcttctgaatttctgttcttgatctgtcatgtataataactgtctagtcttggtgttggtgagatggaaattcggtggatctcggaagggatattgttcgtttgctggggttttttttgtgtgttgtgatccgtagagaatttgtgtttatccatgttgttgatcttggtatgtattcatgacatattgacatgcatgtgttgtatgtgtcatatgtgtgcctctccttgggatttgttttggataatagaacatgttatggactcaatagtctgtgaacaaatctttttttagatggtggccaaatctgatgatgatctttcttgagaggaaaaagttcatgatagaaaaatcttttttgagatggtggcttaatgtgatgatgatctttcttgagaggaaaaaaaagattcattataggagattttgatttagctcctttccaccgatattaaatgaggagcatgcatgctgattgctgataaggatctgatttttttatcccctcttctttgaacagacaagaaataggctctgaatttctgattgattatttgtacatgcagaagggcgaattcgacccaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtg

SEQ ID NO: 144 - DNA, 21 bp, Zea mays
aagctcaggagggatagcgcc

SEQ ID NO: 145 - DNA, 21 bp, Zea mays
ggcgctatctatcctgagctc

SEQ ID NO: 146 - DNA, 693 bp, Zea mays
gcagcgtcggtggttgcttcatggctgtcgaggggaatgacgtccggtccgaacaagccacggctgctgctgcgctaccgccgcggcttcggaccaggcttcattccccacgactcaccatggaaacggcagcgaggtgcgagcttccagtgcgcgcagtgtttgatcagcaaacacctgcgtggccgaggctgagccttgcaagggcaggcgtccatgttctcgtcagcaagcgtcttcttcacatgtctgaggtctgagcaattgcgggtggacatcgatggatgagcattgccgctgcaagggaagatcgtccggctcacacttgagttgggataccatgcactactcttgttgtagttagattagataccatgcgcttgaaccgtgcaatagcatagcgaggaagaggaacccagagaggactcagaaagagatgttgtctatttcatccagtgctcatctagtcatctagtctgcctgcgggtgtctgcaatgaacgctgacgctgctgccggagacctactctgctactggtgtggagtggacaaacagggagggaaggcgtctgctagaacctagaagacggacacagggaggaccaacaggactaaagaccgtcgtacgtgttgaagcggaaggactttcttattacgtgtggcgcttcgaattaaagccagcggttagaacggc

SEQ ID NO: 147 - DNA, 13359 bp, Artificial sequence
  pRCB10:  a binary vector containing engineered maize miR166 to express miR390 under control of ScBV promoter and NOS terminator
  repeat_region (184)..(208): Left T-DNA Border repeat region
  promoter (299)..(2286): Ubiquitin promoter from Zea mays
  terminator (2320)..(4236): Acetohydroxyacid synthase (AHAS108) Large Subunit 2 with Ser653Asn substitution from Zea mays
  promoter (5543)..(7530): Ubiquitin promoter from Zea mays [Dow version]
  prim_transcript (7621)..(8319): maize miR166 precursor with miR166 and miR166 star replaced with miR390 and miR390 star respectively
  misc_feature (7658)..(7678): miR390 star
  misc_feature (7715)..(7735): miR390
  terminator (8382)..(8634): 3'UTR of Nopaline Synthase from Agrobacterium tumefaciens
  repeat_region (8729)..(8752): Right T-DNA Border repeat region
agatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatccactagttctagaaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgatccccgcaagggcgccgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgcggcctccggctacgcgcgctcctcgggccgcgtcggcgtctgcatcgccacctccggccccggcgccaccaaccttgtctccgcgctcgccgacgcgctgctcgattccgtccccatggtcgccatcacgggacaggtgccgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccggggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcccggcgccctgttctttatgttggcggtggctgcgcagcatctggtgaggagttgcgacgctttgtggagctgactggaatcccggtcacaactactcttatgggcctcggcaacttccccagcgacgacccactgtctctgcgcatgctaggtatgcatggcacggtgtatgcaaattatgcagtggataaggccgatctgttgcttgcacttggtgtgcggtttgatgatcgtgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggccaacccaggtgttactgttgttgacatcgatggagatggtagctttctcatgaacgttcaggagctagctatgatccgaattgagaacctcccggtgaaggtctttgtgctaaacaaccagcacctggggatggtggtgcagtgggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctaatggtggggctttcaaggatatgatcctggatggtgatggcaggactgtgtactgatctaaaatccagcaagcaactgatctaaaatccagcaagcaccgcctccctgctagtacaagggtgatatgtttttatctgtgtgatgttctcctgtattctatctttttttgtaggccgtcagctatctgttatggtaatcctatgtagcttccgaccttgtaattgtgtagtctgttgttttccttctggcatgtgtcataagagatcatttaagtgccttttgctacatataaataagataataagcactgctatgcagtggttctgaattggcttctgttgccaaatttaagtgtccaactggtccttgcttttgttttcgctatttttttccttttttagttattattatattggtaatttcaactcaacatatgatgtatggaataatgctagggctgcaatttcaaactattttacaaaccagaatggcattttcgtggtttgaggggagtgaaaaaaaatgaggcatttgactgaattagttacctgatccattttcgtggtttggatcattggaattaaattccattctaataatagtaattttggcatatatcaattaagttaattcggttttatgcaaaatatatttgtatactattattatcaagatgtcggagatatttatatgctacatttttactatacaggagtgagatgaagagtgtcatgtaagttacacagtagaaacaaattctattaatgcataaaatcatttccatcatccaccctatgaatttgagatagacctatatctaaactttgaaaagtggttgaatatcaaattccaaattaaataagttattttattgagtgaattctaatttctctaaaacgaagggatctaaacgccctctaaagctaatttggaaactcaaactttcttagcattggaggggattgagaaaaaatattaattcattttcatctcaatcattcaatctccaaagagatttgagttccttattagtctgttccatgcatcaaatcggctcaatgtgtcattatttgccatgacgattgacgagttgttctggggcctagcgctttccacgccgatgtgctggggcctggtcctggagaagacagcttgatatttaaagctatcaattgtttcaattgattcccacttcatttttctaaatgtagaaaacggtgacgtataagaaaaagaatgaattaggacttttattccgtacactaatctagagcggccgcaagcttgtacaacgcgtaccggttaattaaattacgccaagctatcaactttgtatagaaaagttgtccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatccactagtggccaagtttgtacaaaaaagcaggctccgaattcgcccttggaattcttaattaactgcagatatcggtaccgcagcgtcggtggttgcttcatggctgtcgaggcgctatctatcctgagctcacaagccacggctgctgctgcgctaccgccgcggctaagctcaggagggatagcgccacgactcaccatggaaacggcagcgaggtgcgagcttccagtgcgcgcagtgtttgatcagcaaacacctgcgtggccgaggctgagccttgcaagggcaggcgtccatgttctcgtcagcaagcgtcttcttcacatgtctgaggtctgagcaattgcgggtggacatcgatggatgagcattgccgctgcaagggaagatcgtccggctcacacttgagttgggataccatgcactactcttgttgtagttagattagataccatgcgcttgaaccgtgcaatagcatagcgaggaagaggaacccagagaggactcagaaagagatgttgtctatttcatccagtgctcatctagtcatctagtctgcctgcgggtgtctgcaatgaacgctgacgctgctgccggagacctactctgctactggtgtggagtggacaaacagggagggaaggcgtctgctagaacctagaagacggacacagggaggaccaacaggactaaagaccgtcgtacgtgttgaagcggaaggactttcttattacgtgtggcgcttcgaattaaagccagcggttagaacggcccgggccggccaagcttgggaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaactttattatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcg

SEQ ID NO: 148 - DNA, 21 bp, Zea mays
gtgctctctctcttctgtcaa

SEQ ID NO: 149 - DNA, 21 bp, Zea mays
tggagctcccttcactccaag

SEQ ID NO: 150 - DNA, 21 bp, Zea mays
ctgggatgaagcctggtccgg

SEQ ID NO: 151 - DNA, 21 bp, Zea mays
ctgcagcatcatcaggattcc

SEQ ID NO: 152 - DNA, 3714 bp, Artificial sequence
  pRMW31:  Gateway entry vector containing Arabidopsis leaf-preferred promoter pUK398
  terminator/t_rrnB_T2 (268)..(295)
  terminator/t_rrnB_T1 (427)..(470)
  misc_recomb/mr_attL4 (593)..(688)
  promoter/pUK398 (1034)..(1739)
  misc_recomb/mr-attR4 (1756)..(1912): complementary
  promoter/p-T7 (1958)..(1974): complementary
  CDS/c-KanR (2108)..(2917)
  rep_origin/0-PUC (3038)..(3711)
  rep_origin/o-pUC (3038)..(3711)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggcccgagttaacgctaccatggagctccaaataatgattttattttgactgatagtgacctgttcgttgcaacaaattgataagcaatgcttttttataatgccaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagttgaacgagaaacgtaaaatgatataaatatcaatatattaaattagattttgcataaaaaacagactacataatactgtaaaacacaacatatgcagtcactatgaaccaactacttagatggtattagtgacctgtagaattaattcgagctctagagctgcagggcggccgcgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 153 - DNA, 3506 bp, Artificial sequence
  pRLM257:  Gateway entry vector containing faba bean seed-specific promoter pUSP
  misc_recomb/attL4 (67)..(162)
  promoter/p-USP (164)..(838)
  misc_recomb/attR1 (850)..(1006)
  promoter/p-T7 (1048)..(1064): complementary
  promoter/p-bla (1200)..(1298)
  CDS/c-bla_AmpR (1299)..(2159)
  rep_origin/o-pUC (2304)..(2977)
  terminator/t-rrn_T2 (3248)..(3275)
  terminator/t-rrn_T1 (3407)..(3450)
tcacgacgttgtaaaacgacggccagtcttaagctcgggcccgagttaacgctaccatggagctccaaataatgattttattttgactgatagtgacctgttcgttgcaacaaattgataagcaatgcttttttataatgccaactttgtatagaaaagttgtcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcgttccaagatgcccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtggcgcgccaagtttgtacaaaaaagttgaacgagaaacgtaaaatgatataaatatcaatatattaaattagattttgcataaaaaacagactacataatactgtaaaacacaacatatgcagtcactatgaaccaactacttagatggtattagtgacctgtagaattcgagctctagagctgcagggcggccgcgatatcccctatagtgagtcgtattacatggtcatagctgtttcctggcagctctggcccgtgtctcaaaatctctgatgttacattgcacaagataaaataatatcatcatgacatttaaatggacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccag

SEQ ID NO: 154 - DNA, 8841 bp, Artificial sequence
  pRMW18 is identical to pRMW19 except that each one of the 3'D2, 3'D4 and 3'D6 regions is replaced with a 21-nt sequence targeting to a GUS middle region, and that position 6999 in attB4 region is an A instead of a C.
  misc_feature/attB3_part_2 (1)..(14): complementary
  misc_feature/b-RB (69)..(214): complementary
  misc_feature/b-RB_repeat (109)..(132): complementary
  CDS/c-NPTII (379)..(1173): complementary
  rep_origin/o-ColE1 (1470)..(2151)
  rep_origin/o-BOM-ColE1 (1891)..(2151)
  rep_origin/VS1-rep (2561)..(3561)
  rep_origin/VS1-sta (4154)..(5155)
  mics_b-LB (5601)..(5815): complementary
  mics_b-LB_repeat (5647)..(5671): complementary
  terminator/t-NOS (5833)..(6085): complementary
  CDS/c-BAR (6127)..(6678): complementary
  promoter/p-NOS (6688)..(6974): complementary
  misc_feature/attB4 (6988)..(7008)
  promoter/p-USP (7010)..(7684)
  misc_feature/attB1 (7696)..(7716)
  prim_transcript/GUS_3M_ta-siRNA_precursor (7729)..(8536)
  misc_feature/3'D1 (8169)..(8189)
  misc_feature/3'D2_GUSM (8190)..(8210)
  misc_feature/3'D3 (8211)..(8231)
  misc_feature/3'D4_GUSM (8232)..(8252)
  misc_feature/3'D5 (8253)..(8273)
  misc_feature/3'D6_GUSM (8274)..(8294)
  misc_feature/3'D7 (8295)..(8315)
  misc_feature/3'D8 (8316)..(8336)
  misc_feature/attB2 (8549)..(8569): complementary
  terminator/t-NOS (8575)..(8827)
  misc_feature/attB3_part_I (8835)..(8841): complementary
  misc_feature/attB3_part_1 (8835)..(8841): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttgtcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcgttccaagatgcccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtggcgcgccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcataatcgcctgtaagtgcactccgataagatcttagaaaattataatcgcctgtaagtgcactctgattggatcttaggaaattataatcgcctgtaagtgcactcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 155 - DNA, 8841 bp, Artificial sequence
  pRMW19 is identical to pRMW22 except that each one of the 3'D2, 3'D4 and 3'D6 regions is replaced with a 21-nt sequence targeting to a GUS 3' region, and that position 8351-8352 sequence is CA instead AT to create a NcoI cloning site.
  prim_transcript/TAS1a-GUS-3C-ta-siRNA_precursor (7729)..(8536)
  misc_feature/3'D2_GUSC (8190)..(8210)
  misc_feature/3'D4_GUSC (8232)..(8252)
  misc_feature/3'D6_GUSC (8274)..(8294)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttgtcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcgttccaagatgcccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtggcgcgccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattaccatccgtaataacagtccgataagatcttagaaaattattaccatccgtaataacagtctgattggatcttaggaaattattaccatccgtaataacagtcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 156 - DNA, 8841 bp, Artificial sequence; identical to SEQ ID NO: 155
  pRMW20 is identical to pRMW19 except that each one of the 3'D2, 3'D4 and 3'D6 regions is replaced with one 21-nt sequence targeting to GUS 5' region, middle region and 3' region respectively.
  prim_transcript/TAS1-GUS-NMC-ta-siRNA-precursor (7729)..(8536)
  misc_feature/3'D2_GUS_N (8190)..(8210)
  misc_feature/3'D4_GUS_M (8232)..(8252)
  misc_feature/3'D6_GUS_C (8274)..(8294)

SEQ ID NO: 157 - DNA, 8841 bp, Artificial sequence
  pRMW21 is identical to pRMW19 except that each one of the 3'D2, 3'D4 and 3'D6 regions is replaced with a 21-nt random sequence.
  prim_transcript/TAS1a-GUS-Random-ta-siRNA-precursor (7229)..(8536)
  misc_feature/3'D2_GUS_Random (8190)..(8210)
  misc_feature/3'D4_GUS_Random (8232)..(8252)
  misc_feature/3'D6_GUS_Random (8274)..(8294)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttgtcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcgttccaagatgcccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtggcgcgccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcactcacgtgaatgtccgctaatcgataagatcttagaaaattactcacgtgaatgtccgctaattgattggatcttaggaaattactcacgtgaatgtccgctaatgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 158 - DNA, 8841 bp, Artificial sequence
  pRMW22 is a binary plant expression vector containing pUSP::TAS1a(At2g27400)::tNOS cassette and  pNOS::Bar-R::tNOS cassete.
  misc_feature/attB3-part2 (1)..(14): complementary
  misc_feature/b-LB (69)..(214): complementary
  misc_feature/b-LB-repeat (109)..(132): complementary
  CDS'c-NPTII (379)..(1173)
  rep_origin/o-ColE1 (1470)..(2151)
  rep_origin/o-BOM-ColE1 (1891)..(2151)
  rep_origin/VS1-rep (2561)..(3561)
  misc_feature/VS1-sta (4154)..(5155)
  misc_feature/b-LB (5601)..(5815): complementary
  misc_feature/b-LB-repeat (5647)..(5671): complementary
  terminator/t-NOS (5833)..(6085): complementary
  CDS/c-BAR (6127)..(6678): complementary
  promoter/p-NOS(lm243) (6688)..(6974): complementary
  misc_feature/attB4 (6988)..(7008)
  promoter/pUSP (7010)..(7684)
  prim_transcript/TAS1a-ta-siRNA(AT2g27400)-precursor (7229)..(8536)
  misc_RNA/ta-siRNA(AT2g27400)_precursor (7229)..(8536)
  misc_feature/miR173-binding-site (8157)..(8178)
  misc_feature/3'D1 (8169)..(8189)
  misc_feature/3'D2 (8190)..(8210)
  misc_feature/3'D3 (8211)..(8231)
  misc_feature/3'D4 (8232)..(8252)
  misc_feature/3'D5 (8253)..(8273)
  misc_feature/3'D6 (8274)..(8294)
  misc_feature/3'D7 (8295)..(8315)
  misc_feature/3'D8 (8316)..(8336)
  misc_feature/attB2 (8549)..(8569): complementary
  terminator/t-NOS (8575)..(8827)
  misc_feature/attB3-part1 (8835)..(8841): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttgtcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcgttccaagatgcccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtggcgcgccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcctaagtccaacatagcgttcgataagatcttagaaaattattttaagtctaacatagcgtttgattggatcttaggaaattattctaagtccaacatagcgtagagaaatggaagatatcgtgaatgatatttgtagtaatggcgaaactagaaaaagcattggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 159 - DNA, 9221 bp, Artificial sequence
  pRMW40 is identical to pRMW44 except that each one of the 3'D2, 3'D4 and 3'D6 regions is replaced with a 21-nt sequence targeting to a GUS middle region, and that  position 8055-8056 sequence is CA instead of AT to create a NcoI cloning site.
  misc_feature/attB3-part2 (1)..(14): complementary
  mice_feature/b-RB (69)..(214): complementary
  mice_feature/b-RB-repeat (109)..(132): complementary
  CDS/c-NPTII (379)..(1173)
  rep_origin/o-ColE1 (1470)..(2151)
  rep_origin/o-BOM-ColE1 (1891)..(2151)
  rep_origin/VS1-rep (2561)..(3561)
  misc_feature/VS1-sta (4154)..(5155)
  misc_feature/b-LB (5601)..(5815): complementary
  misc_feature/b-LB-repeat (5647)..(5671): complementary
  terminator/t-NOS (5833)..(6085): complementary
  CDS/c-BAR (6127)..(6678): complementary
  promoter/p-NOS (6688)..(6974): complementary
  misc_feature/attB4 (6988)..(7008)
  promoter/p-UK398 (7026)..(8059)
  misc_feature/attB1 (8076)..(8096)
  prim_transcript/TAS1a-GSU-3M-ta-siRNA-precursor (8109)..(8916)
  misc_feature/3'D1 (8549)..(8569)
  misc_feature/3'D2-GUS-M (8570)..(8590)
  misc_feature/3'D3 (8591)..(8611)
  misc_feature/3'D4-GUS-M (8612)..(8632)
  misc_feature/3'D5 (8633)..(8653)
  misc_feature/3'D6-GUS-M (8654)..(8674)
  misc_feature/3'D7 (8675)..(8695)
  misc_feature/3'D8 (8696)..(8716)
  misc_feature/attB2 (8929)..(8949): complementary
  terminator/t-NOS (8955)..(9207)
  misc_feature/attB3-part1 (9215)..(9221): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcataatcgcctgtaagtgcactccgataagatcttagaaaattataatcgcctgtaagtgcactctgattggatcttaggaaattataatcgcctgtaagtgcactcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 160 - DNA, 9221 bp, Artificial sequence
  pRMW41 is identical to pRMW40 except that each one of the 3'D2, 3'D4 and 3'D6 regions is replaced with a 21-nt sequence targeting to a GUS 3' region, and that position 6999 in attB4 region is an A instead of a C.
  prim_transcript/TAS1a-GUS-3C-ta-siRNA-precursor (8109)..(8916)
  misc_feature/3'D2-GUS-C (8570)..(8590)
  misc_feature/3'D4-GUS-C (8612)..(8632)
  misc_feature/3'D6-GUS-C (8654)..(8674)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattaccatccgtaataacagtccgataagatcttagaaaattattaccatccgtaataacagtctgattggatcttaggaaattattaccatccgtaataacagtcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 161 - DNA, 9190 bp, Artificial sequence
  pRMW17is a binary plant expression vector containing pPcUbi4-2::TAS1a (At2g27400)::tNOS cassette and pNOS::bar-R::tNOS cassette.
  misc_feature/attB3-part2 (1)..(14): complementary
  misc_feature/b-RB (69)..(214): complementary
  misc_feature/b-RB-repeat (109)..(132): complementary
  CDS/c-NPTII (379)..(1173)
  rep_origin/o-ColE1 (1470)..(2151)
  rep_origin/o-BOM-ColE1 (1891)..(2151)
  rep_origin/VS1-rep (2561)..(3561)
  misc_feature/VS1-sta (4154)..(5155)
  misc_feature/b-LB (5601)..(5815): complementary
  misc_feature/b-LB-repeat (5647)..(5671): complementary
  terminator/t-NOS (5833)..(6085): complementary
  CDS/c-BAR (6127)..(6678): complementary
  promoter/p-NOS(lm243) (6688)..(6974): complementary
  misc_feature/attB4 (6988)..(7008): complementary
  promoter/pPcUbi4-2 (7028)..(8023)
  misc_feature/attB1 (8045)..(8065)
  prim_transcript/TAS1a(At2g27400)-ta-siRNA-precursor (8078)..(8885)
  misc_feature/attB2 (8898)..(8918): complementary
  terminator/t-NOS (8924)..(9176)
  misc_feature/attB3-part1 (9184)..(9190): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcctaagtccaacatagcgttcgataagatcttagaaaattattttaagtctaacatagcgtttgattggatcttaggaaattattctaagtccaacatagcgtagagaaatggaagatatcgtgaatgatatttgtagtaatggcgaaactagaaaaagcattggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 162 - DNA, 9221 bp, Artificial sequence
  pRMW42 is identical to pRMW40 except that each one of the 3'D2, 3'D4 and 3'D6 regions is replaced with a 21-nt sequence targeting to GUS 5' region, middle region and 3' region respectively.
  prim_transcript/TAS1a-GUS-NMC-ta-siRNA-precursor (8109)..(8916)
  misc_feature/3'D2-GUS-N (8570)..(8590)
  misc_feature/3'D4-GUS-M (8612)..(8632)
  misc_feature/3'D6-GUS-C (8654)..(8674)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatacctttcggtataaagcctccgataagatcttagaaaattataatcgcctgtaagtgcactctgattggatcttaggaaattattaccatccgtaataacagtcgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 163 - DNA, 9221 bp, Artificial sequence; identical to SEQ ID NO: 162
  pRMW43 is identical to pRMW40 except that each one of the 3'D2, 3'D4 and 3'D6 regions is replaced with a random 21-nt sequence.
  prim_transcript/TAS1a-GUS-Random-ta-siRNA-precursor (8109)..(8916)
  misc_feature/3'D2-GUS-Random (8570)..(8590)
  misc_feature/3'D4-GUS-Random (8612)..(8632)
  misc_feature/3'D6-GUS-Random (8654)..(8674)

SEQ ID NO: 164 - DNA, 9221 bp, Artificial sequence
  pRMW44 is a binary plant expression vector containing pUK398::TAS1a (At2g27400)::tNOS cassette and pNOS::bar-R::tNOS cassette.
  misc_geature/attB3-part2 (1)..(14): complementary
  misc_feature/b-RB (69)..(214): complementary
  misc_feature/b-RB-repeat (109)..(132): complementary
  CDS/c-NPTII (379)..(1173)
  rep_origin/o-ColE1 (1470)..(2151)
  rep_origin/o-BOM-ColE1 (1891)..(2151)
  rep_origin/VS1-rep (2561)..(3561)
  misc_feature/VSi-sta (4154)..(5155)
  misc_feature/b-LB (5601)..(5815): complementary
  misc_feature/b-LB-repeat (5647)..(5671): complementary
  terminator/t-NOS (5833)..(6085): complementary
  CDS/c-BAR (6127)..(6678): complementary
  promoter/p-NOS (6688)..(6974): complementary
  misc_feature/attB4 (6988)..(7008)
  promoter/pUK398 (7026)..(8059)
  misc_feature/attB1 (8076)..(8096)
  prim_transcript/TAS1a(At2g274000-ta-siRNA-precursor (8109)..(8916)
  misc_feature/miR173-binding-site (8537)..(8558)
  misc_feature/3'D1 (8549)..(8569)
  misc_feature/3'D2 (8570)..(8590)
  misc_feature/3'D3 (8591)..(8611)
  misc_feature/3'D4 (8612)..(8632)
  misc_feature/3'D5 (8633)..(8653)
  misc_feature/3'D6 (8654)..(8674)
  misc_feature/3'D7 (8675)..(8695)
  misc_feature/3'D8 (8696)..(8716)
  misc_feature/attB2 (8929)..(8949): complementary
  terminator/t-NOS (8955)..(9207)
  misc_geature/attB3-part1 (9215)..(9221): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatcgaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcctaagtccaacatagcgttcgataagatcttagaaaattattttaagtctaacatagcgtttgattggatcttaggaaattattctaagtccaacatagcgtagagaaatggaagatatcgtgaatgatatttgtagtaatggcgaaactagaaaaagcattggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 165 - DNA, 4023 bp, Artificial sequence
  pRMW38:  Gateway entry vector containing gene of interest TAS1a (At2g27400) from Arabidopsis.
  terminator/rrnB-T2 (268)..(295)
  Tterminator/rrnB-T1 (427)..(470)
  misc_recomb/attL1 (569)..(668)
  prim_transcript/ta-siRNA(At3g17185,TAS3)-precursor (683)..(1882)
  misc_feature/5'D8 (1548)..(1568)
  misc_feature/5'D7 (1569)..(1589)
  misc_feature/5'D6 (1590)..(1610)
  misc_feature/5'D5 (1611)..(1631)
  misc_feature/5'D4 (1632)..(1652)
  misc_feature/5'D3 (1653)..(1673)
  misc_feature/5'D2 (1674)..(1694)
  misc_feature/5'D1 (1695)..(1715)
  misc_feature/miR390-binding-site (1704)..(1725)
  misc_recomb/attL2 (1902)..(2001)
  promoter/p-SpecR (2136)..(2269)
  CDS/c-SpecR (2270)..(3280)
  rep_origin/o-pUC (3347)..(4020)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 166 - DNA, 4023 bp, Artificial sequence
  pRMW53 is a Gateway gene of interest entry vector containing TAS3/GUS-M.  It is identical to pRMW38 except that 5'D7 and 5'D8 regions are replaced with a 21-nt sequence targeting to a GUS middle region.
  prim_transcript/TAS3-GUS-M-ta-siRNA-precursor (683)..(1882)
  misc_feature/5'D8-GUS-M (1548)..(1568)
  misc_feature/5'D7-GUS-M (1569)..(1589)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctcttttaatcgcctgtaagtgcactctaatcgcctgtaagtgcactcatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 167 - DNA, 4023 bp, Artificial sequence
  pRMW54 is a Gateway entry vector containing gene of interest TAS3/GUS-C.  It is identical to pRMW38 except that 5'D7 and 5'D8 regions are replaced with a 21-nt sequence targeting to a GUS 3' region.
  prim_transcript/TAS3-GUS-C-ta-siRNA-precursor (683)..(1882)
  misc_feature/5'D8-GUS-C (1548)..(1568)
  misc_feature/5'D7-GUS-C (1569)..(1589)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttaccatccgtaataacagtcttaccatccgtaataacagtcatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 168 - DNA, 9597 bp, Artificial sequence
  pRMW76 is a binary plant expression vector containing pPcUbi::TAS3 (At3g17185)::tNOS cassette and pNOS::Bar-R::tNOS cassette.
  misc_feature/attB3-part2 (1)..(14): complementary
  misc_feature/b-RB (69)..(214)
  misc_feature/b-RB-repeat (109)..(132)
  promoter/p-KanP (241)..(378)
  CDS/c-NPTII(bps03) (379)..(1173)
  rep_origin/o-ColE1 (1470)..(2151)
  rep_origin/o-Rep-ColE1 (1471)..(1751)
  rep_origin/o-BOM-ColE1 (1891)..(2151)
  CDS/c-RepA (2785)..(3892): complenentary
  CDS/c-StaA (4287)..(4916): complenentary
  misc_feature/b-LB (5601)..(5815)
  misc_feature/b-LB-repeat (5647)..(5671)
  terminator/t-NOS (5833)..(6085): complementary
  CDS/c-BAR (6127)..(6678): complementary
  promoter/p-NOS (6688)..(6974): complementary
  misc_feature/attB4 (6988)..(7008)
  promoter/p-PcUbi4-2 (7028)..(8023)
  misc_feature/attB1 (8045)..(8065)
  prim_transcript/TAS3(At3g17185)-ta-siRNA-precursor (8083)..(9282)
  misc_feature/5'D8 (8948)..(8968)
  misc_feature/5'D7 (8969)..(8989)
  misc_feature/5'D6 (8990)..(9010)
  misc_feature/5'D5 (9011)..(9031)
  misc_feature/5'D4 (9032)..(9052)
  misc_feature/5'D3 (9053)..(9073)
  misc_feature/5'D2 (9074)..(9094)
  misc_feature/5'D1 (9095)..(9115)
  misc_feature/miR390-binding-site (9104)..(9125)
  misc_feature/attB2 (9305)..(9325): complementary
  terminator/t-NOS (9331)..(9583)
  misc_feature/attB3-part1 (9591)..(9597): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 169 - DNA, 9597 bp, Artificial sequence
  pRMW74 is identical to pRMW76 except that 5'D7 and 5'D8 regions are replaced with a 21-nt sequence targeting to a GUS middle region.
  prim_transcript/TAS3-GUS-M-ta-siRNA-precursor (8083)..(9282)
  misc_feature/5'D8-GUS-M (8948)..(8968)
  misc_feature/5'D7-GUS-M (8969)..(8989)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctcttttaatcgcctgtaagtgcactctaatcgcctgtaagtgcactcatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 170 - DNA, 9597 bp, Artificial sequence
  pRMW75 is identical to pRMW76 except that 5'D7 and 5'D8 regions are replaced with a 21-nt sequence targeting to a GUS 3' region, and that position 137 in b-RB region is a C instead of a G.
  prim_transcript/TAS3-GUS-C-ta-siRNA-precursor (8083)..(9282)
  misc_feature/5'D8-GUS-C (8948)..(8968)
  misc_feature/5'D7-GUS-C (8969)..(8989)
attatacatagttgataagcgatcgcagcttggcgtaatcatggtcatagctgtttcctactagatctgattgtcgtttcccgccttcagtttaaactatcagtgtttgacaggatatattggcgggtaaacctaacagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttaccatccgtaataacagtcttaccatccgtaataacagtcatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 171 - DNA, 9628 bp, Artificial sequence
  pRMW79 is a binary plant expression vector containing pUK398::TAS3 (At3917185)::tNOS cassette and pNOS::Bar-R::tNOS cassette.
  misc_feature/attB3-part2 (1)..(14): complementary
  misc_feature/b-RB (69)..(214)
  misc_feature/b-RB-repeat (109)..(132)
  promoter/pKanP (241)..(378)
  CDS/c-NPTII(bps03) (379)..(1173)
  rep-origin/o-ColE1 (1470)..(2151)
  rep-origin/o-Rep-ColE1 (1471)..(1751)
  rep-origin/o-BOM-ColE1 (1891)..(2151)
  rep-origin/o-pVS1-origin (2525)..(2719): complementary
  CDS/c-RepA (2785)..(3892): complementary
  CDS/c-StaA (4287)..(4916): complementary
  misc_feature/b-LB (5601)..(5815)
  misc_feature/b-LB-repeat (5647)..(5671)
  terminator/t-NOS (5833)..(6085): complementary
  CDS/c-BAR (6127)..(6678): complementary
  promoter/p-NOS (6688)..(6974): complementary
  misc_feature/attB4 (6988)..(7008)
  promoter/pUK398 (7026)..(8059)
  misc_feature/attB1 (8076)..(8096)
  prim_transcript/TAS3(At3g17185)-ta-siRNA-precursor (8114)..(9313)
  misc_feature/5'D8 (8979)..(8999)
  misc_feature/5'D7 (9000)..(9020)
  misc_feature/5'D6 (9021)..(9041)
  misc_feature/5'D5 (9042)..(9062)
  misc_feature/5'D4 (9063)..(9083)
  misc_feature/5'D3 (9084)..(9104)
  misc_feature/5'D2 (9105)..(9125)
  misc_feature/5'D1 (9126)..(9146)
  misc_feature/miR390-binding-site (9135)..(9156)
  misc_feature/attB2 (9336)..(9356): complementary
  terminator/t-NOS (9362)..(9614)
  misc_feature/attB3-part1 (9622)..(9628): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 172 - DNA, 9628 bp, Artificial sequence
  pRMW77 is identical to pRMW79 except that 5'D7 and 5'D8 regions are replaced with a 21-nt sequence targeting to a GUS middle region.
  prim_transcript/TAS3-GUS-M-ta-siRNA-precursor (8114)..(9313)
  misc_feature/5'D8-GUS-M (8979)..(8999)
  misc_feature/5'D7-GUS-M (9000)..(9020)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctcttttaatcgcctgtaagtgcactctaatcgcctgtaagtgcactcatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 173 - DNA, 9628 bp, Artificial sequence
  pRMW78 is identical to pRMW79 except that 5'D7 and 5'D8 regions are replaced with a 21-nt sequence targeting to a GUS 3' region.
  prim_transcripts/TAS3-GUS-C-ta-siRNA-precursor (8114)..(9313)
  misc_feature/5'D8-GUS-C (8979)..(8999)
  misc_feature/5'D7-GUS-C (9000)..(9021)
  misc_feature/5'D7-GUS-C (9000)..(9020)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttaccatccgtaataacagtcttaccatccgtaataacagtcatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 174 - DNA, 8675 bp, Artificial sequence
  pRLM402:  Gateway destination vector for generating plant expression vector containing Bar-R gene.
  misc_feature/b-RB (53)..(267)
  misc_feature/b-RB-repeat (99)..(123)
  terminator/t-NOS (285)..(537): complementary
  CDS/c-BAR(ew105) (579)..(1130): complementary
  promoter/p-NOS(lm243) (1140)..(1426)
  misc_recomb/mr-attB4 (1440)..(1460)
  misc_recomb/mr-attR4 (1440)..(1564)
  CDS/c-ccdB(lm217) (1604)..(1909): complementary
  misc_feature/mf-ccdA(lm217) (2045)..(2131): complementary
  CDS/c-Cmr(lm217) (2229)..(2909): complementary
  misc_recomb/mr-attR3 (3017)..(3141)
  misc_recomb/mr-attB3 (3121)..(3141): complementary
  misc_feature/b-RB (3196)..(3341)
  misc_feature/b-RB-repeat (3236)..(3259)
  CDS/c-NptII(bps03) (3506)..(4300)
  rep_origin/o-ColE1 (4597)..(5278)
  rep_origin/o-Rep-ColE1 (4598)..(4878)
  rep_origin/o-BOM-ColE1 (5018)..(5278)
  rep_origin/o-pVS1-origin (5652)..(5846): complementary
  CDS/c-RepA (5912)..(7019): complementary
  CDS/c-staA (7414)..(8043): complementary
ccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttgaacgagaaacgtaaaatgatataaatatcaatatattaaattagattttgcataaaaaacagactacataatactgtaaaacacaacatatccagtcactatggtcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggggactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcggcaaaagagccgttcatttcaatgaaccgggcgacctcagccatcccttcctgattttccgctttccagcgttcggcacgcagacgacgggcttcattctgcatggttgtgcttaccgaaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatcctctagattacgccccgcctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacggatcctaactcaaaatccacatattatacgagccggaagcataaagtgtaaagcctggggtgcctaatgcggccgccatagtgactggatatgttgtgttttacagtattatgtagtctgttttttatgcaaaatctaatttaatatattgatatttatatcattttacgtttctcgttcaactttattatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatg

SEQ ID NO: 175 - DNA, 3616 bp, Artificial sequence
  Gateway entry vector containing TAS1a/PDS1.  It is identical to pRMW1 except that 3'D2(+), 3'D6(+) and 3'D8(+) are each replaced with a 21-nt sequence targeting to PDS 247-261 region (PDS1) and that position 1300-1301 is CA instead of AT to create a NcoI
  terminator/rrnB-T2 (268)..(295)
  terminator/rrnB-T1 (427)..(470)
  misc_recomb/attL1 (569)..(668)
  prim_transcript/TAS1a-PDS1-ta-siRNA-precursor (678)..(1485)
  misc_feature/miR173-binding-site (1106)..(1127)
  misc_feature/3'D1 (1118)..(1138)
  misc_feature/3'D2-PDS1 (1139)..(1159)
  misc_feature/3'D3 (1160)..(1180)
  misc_feature/3'D4-PDS1 (1181)..(1201)
  misc_feature/3'D5 (1202)..(1222)
  misc_feature/3'D6-PDS1 (1223)..(1243)
  misc_feature/3'D7 (1244)..(1264)
  misc_feature/3'D8 (1265)..(1285)
  misc_recomb/attL2 (1495)..(1594)
  promoter/p-Spec (1729)..(1862)
  CDS/c-specR (1863)..(2873)
  rep_origin/o-pUC-ori (2940)..(3613)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattcttgtcttaagcgcttgagcgataagatcttagaaaattattcttgtcttaagcgcttgagtgattggatcttaggaaattattcttgtcttaagcgcttgaggagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 176 - DNA, 3616 bp, Artificial sequence
  pRMW39 is a Gateway entry vector containing gene of interest TAS1a/PDS3.  It is identical to pRMW27 except that the 3'D2, 3'D4 and 3'D6 regions are replaced with a 21-nt sequence targeting to PDS 1331-1351 region (PDS3).
  prim_transcript/TAS1a-PDS3-ta-siRNA-precursor (678)..(1485)
  misc_feature/3'D2-PDS3 (1139)..(1159)
  misc_feature/3'D4-PDS3 (1181)..(1201)
  misc_feature/3'D6-PDS3 (1223)..(1243)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcatatgtgttcttcagttttcgataagatcttagaaaattatcatatgtgttcttcagtttttgattggatcttaggaaattatcatatgtgttcttcagttttgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 177 - DNA, 9221 bp, Artificial sequence
  pRSM1 is identical to pRMW40 except that 3'D2, 3'D4 and 3'D6 regions are replaced with a 21-nt sequence targeting to PDS 987-1007 region (PDS2), and that position 6999 is an A instead of a C.
  misc_feature/attB3-part2 (1)..(14): complementary
  misc_feature/b-RB (69)..(214): complementary
  misc_feature/b-RB-repeat (151)..(174): complementary
  CDS/c-NPTII(bps03) (379)..(1173)
  rep_origin/o-ColE1 (1471)..(1752)
  rep_origin/o-BOM-ColE1 (1891)..(2152)
  rep_origin/VS1-rep (2561)..(3561)
  rep_origin/VS1-sta (4154)..(5155)
  misc_feature/b-LB (5601)..(5815): complementary
  misc_feature/b-LB-repeat (5647)..(5671): complementary
  CDS/c-BAR (6127)..(6678): complementary
  promoter/p-NOS (6689)..(6974): complementary
  misc_feature/attB4 (6988)..(7008)
  promoter/pUK398 (7026)..(8059)
  misc_feature/attB1 (8076)..(8096)
  prim_transcript/TAS1a-PDS2-ta-siRNA-precursor (8109)..(8916)
  misc_feature/miR173-binding-site (8537)..(8558)
  misc_feature/3'D1 (8549)..(8569)
  misc_feature/3'D2-PDS2 (8570)..(8590)
  misc_feature/3'D3 (8591)..(8611)
  misc_feature/3'D4-PDS2 (8612)..(8632)
  misc_feature/3'D5 (8633)..(8653)
  misc_feature/3'D6-PDS2 (8654)..(8674)
  misc_feature/3'D7 (8675)..(8695)
  misc_feature/3'D8 (8696)..(8716)
  misc_feature/attB2 (8929)..(8949): complementary
  terminator/t-NOS (8955)..(9207)
  misc_feature/attB3-part1 (9215)..(9221): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattcctgaagaaaccggttcaacgataagatcttagaaaattattcctgaagaaaccggttcaatgattggatcttaggaaattattcctgaagaaaccggttcaagagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggcgggccaacttt

SEQ ID NO: 178 - DNA, 9221 bp, Artificial sequence
  pRSM2 is identical to pRSM1 except that 3'D2, 3'D4 and 3'D6 regions are replaced with a 21-nt sequence targeting to PDS 1394-1414 region (PDS4).
  prim_transcript/TAS1-PDS4-ta-siRNA-precursor (8109)..(8916)
  misc_feature/3'D2-PDS4 (8570)..(8590)
  misc_feature/3'D4-PDS4 (8612)..(8632)
  misc_feature/3'D6-PDS4 (8654)..(8674)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattacaagttaaggacatgtcgcgataagatcttagaaaattattacaagttaaggacatgtcgtgattggatcttaggaaattattacaagttaaggacatgtcggagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 179 - DNA, 9221 bp, Artificial sequence
  pRSM3 is identical to pRSM1 except that 3'D2, 3'D4 and 3'D6 regions are replaced with a 21-nt sequence targeting to PDS 247-267 region (PDS1).
  prim_transcript/TAS1a-PDS1-ta-siRNA-precursor (8109)..(8916)
  misc_feature/3'D2-PDS1 (8570)..(8590)
  misc_feature/3'D4-PDS1 (8612)..(8632)
  misc_feature/3'D6-PDS1 (8654)..(8674)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattcttgtcttaagcgcttgagcgataagatcttagaaaattattcttgtcttaagcgcttgagtgattggatcttaggaaattattcttgtcttaagcgcttgaggagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 180 - DNA, 9221 bp, Artificial sequence
  pRSM4 is identical to pRSM1 except that 3'D2, 3'D4 and 3'D6 regions are replaced with a 21-nt sequence targeting to PDS 1394-1414 region (PDS4).
  prim_transcripts/TAS1-PDS3-ta-siRNA-precursor (8109)..(8916)
  misc_feature/3'D2-PDS3 (8570)..(8590)
  misc_feature/3'D4-PDS3 (8612)..(8632)
  misc_feature/3'D6-PDS3 (8654)..(8674)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcatatgtgttcttcagttttcgataagatcttagaaaattatcatatgtgttcttcagtttttgattggatcttaggaaattatcatatgtgttcttcagttttgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 181 - DNA, 9190 bp, Artificial sequence
  pRSM5 is a binary plant expression vector containing pPcUbi::TAS1a/PDS2::tNOS cassette and pNOS:: bar-R::tNOS cassette.  Its 3'D2, 3'D4 and 3'D6 regions contain the same 21-nt sequence targeting to Arabidopsis PDS gene 987-1007 region
  misc_feture/attB3-part2 (1)..(14): complementary
  misc_feature/b-RB (69)..(214): complementary
  misc_feature/b-RB-repeat (151)..(174): complementary
  CDS/c-NPTII (379)..(1173)
  rep-origin/o-ColE1 (379)..(1173)
  rep-origin/o-ColE1-bom (1891)..(2152)
  misc_feature/VS1-sta (4154)..(5155)
  misc_feature/b-LB (5601)..(5815): complementary
  misc_feature/b-LB-repeat (5647)..(5671): complementary
  terminator/t-NOS (5833)..(6085): complementary
  CDS/c_BAR (6127)..(6678): complementary
  promote/p-NOS (6689)..(6974): complementary
  misc_feature/attB4 (6988)..(7008)
  promoter/p-PcUbi4-2 (7028)..(8023)
  misc_feature/attB2 (8045)..(8065)
  prim_transcripts/TAS1a-PDS2-ta-siRNA-precursor (8078)..(8885)
  misc_feature/miR173-binding-site (8506)..(8527)
  misc_feature/3'D1 (8518)..(8538)
  misc_feature/3'D2-PDS2 (8539)..(8559)
  misc_feature/3'D3 (8560)..(8580)
  misc_feature/3'D4-PDS2 (8581)..(8601)
  misc_feature/3'D5 (8602)..(8622)
  misc_feature/3'D6-PDS2 (8623)..(8643)
  misc_feature/3'D7 (8644)..(8664)
  misc_feature/3'D8 (8665)..(8685)
  misc_feature/attB2 (8898)..(8918): complementary
  terminator/t-NOS (8924)..(9176)
  misc_feture/attB3-part1 (9184)..(9190): omplementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattcctgaagaaaccggttcaacgataagatcttagaaaattattcctgaagaaaccggttcaatgattggatcttaggaaattattcctgaagaaaccggttcaagagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 182 - DNA, 9190 bp, Artificial sequence
  pRSM6 is identical to pRSM5 except that 3'D2, 3'D4 and 3'D6 regions are replaced with a 21-nt sequence targeting to Arabidopsis PDS gene 1394-1414 region (PDS4).
  prim_transcript/TAS1a-PDS4-ta-siRNA-precursor (8078)..(8885)
  misc_feature/3'D2-PDS4 (8539)..(8559)
  misc_feature/3'D4-PDS4 (8581)..(8601)
  misc_feature/3'D6-PDS4 (8623)..(8643)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattacaagttaaggacatgtcgcgataagatcttagaaaattattacaagttaaggacatgtcgtgattggatcttaggaaattattacaagttaaggacatgtcggagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 183 - DNA, 9190 bp, Artificial sequence
  pRSM7 is identical to pRSM5 except that 3'D2, 3'D4 and 3'D6 regions are replaced with a 21-nt sequence targeting to Arabidopsis PDS gene 247-267 region (PDS1).
  prim_transcript/TAS1a-PDS1-ta-siRNA-precursor (8078)..(8885)
  misc_feature/3'D2-PDS1 (8539)..(8559)
  misc_feature/3'D4-PDS1 (8581)..(8601)
  misc_feature/3'D6-PDS1 (8623)..(8643)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcattcttgtcttaagcgcttgagcgataagatcttagaaaattattcttgtcttaagcgcttgagtgattggatcttaggaaattattcttgtcttaagcgcttgaggagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 184 - DNA, 9190 bp, Artificial sequence
  pRSM6 is identical to pRSM5 except that 3'D2, 3'D4 and 3'D6 regions are replaced with a 21-nt sequence targeting to Arabidopsis PDS gene 1331-1351 region (PDS3).
  prim_transcript/TAS1a-PDS3-ta-siRNA-precursor (8078)..(8885)
  misc_feature/3'D2-PDS3 (8539)..(8559)
  misc_feature/3'D4-PDS3 (8581)..(8601)
  misc_feature/3'D4-PDS3 (8623)..(8643)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcatatgtgttcttcagttttcgataagatcttagaaaattatcatatgtgttcttcagtttttgattggatcttaggaaattatcatatgtgttcttcagttttgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 185 - DNA, 8841 bp, Artificial sequence
  pRMW111 is identical to pRMW19 except that 3'D2, 3'D4 and 3'D6 regions are replaced with a 21-nt sequence targeting to Arabidopsis PDS gene 1331-1351 region (PDS3).
  prim_transcript/TAS1-PDS3-ta-siRNA-precursor (7729)..(8536)
  misc_feature/3'D2-PDS3 (8190)..(8210)
  misc_feature/3'D4-PDS3 (8232)..(8252)
  misc_feature/3'D6-PDS3 (8274)..(8294)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttgtcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcgttccaagatgcccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtggcgcgccaagtttgtacaaaaaagcaggctccgaattcgcccttaggtcaaataaggaaaacgatgggactatataaaccaagtcactctttatacaccacataaacctaaacccctaagcggctaagcctgacgtcatataccaaaaagagtaaacatgagcgccgtcaagctctgcaagtacaatctcatcttaactcaaaagttgagataggttcttagatcaggttccgcctttagatcgagtcatggtcttgtctgatagaaaggtactttcttttacttctcttgattagcgtctatagctagattgagatcgagtttgtgagatgttaggttcgatatccctgtctatttgtcaccagccatgtaggagtttcgtcccttcccctcccgtcgccctctctgtttttggtattcattggaatacggagatatattttcaagaggagaaatattgttttgttgtgatttttctctacaagcgaatgagtcattcatcatatgtgttcttcagttttcgataagatcttagaaaattatcatatgtgttcttcagtttttgattggatcttaggaaattatcatatgtgttcttcagttttgagaaatggaagatatcgtgaatgatatttgtagtaatggcgaaactagaaaaagccatggatatattctaggatatgcaaaagttatccttgaatatgttcacattaaatgttattttctacttaatgaacagttgatgatacaattattttctttaaaattgtttccgtgtaaccaaaacatatttcagtatatgcaaaataaaaaatggatgttggtattcttattttgcaaggcaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 186 - DNA, 4023 bp, Artificial sequence
  pRMW51 is the Gateway entry vector containing TAS3/PDS2 gene.  It is identical to pRMW38 except that 5'D7 and 5'D8 regions are replaced with a 21-nt sequences targeting to Arabidopsis PDS 987-1007 region (PDS2).
  prim_transcript/TAS3-PDS2-ta-siRNA-orecursor (683)..(1882)
  misc_feature/5'D8-PDS2 (1548)..(1568)
  misc_feature/5'D7-PDS2 (1569)..(1589)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttcctgaagaaaccggttcaattcctgaagaaaccggttcaaatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 187 - DNA, 4023 bp, Artificial sequence
  pRMW52 is the Gateway entry vector containing TAS3/PDS4 gene.  It is identical to pRMW38 except that 5'D7 and 5'D8 regions are replaced with a 21-nt sequences targeting to Arabidopsis PDS 1394-1414 region (PDS4).
  prim_transcript/TAS3-PDS4-ta-siRNA-precursor (683)..(1882)
  misc_feature/5'D8-PDS4 (1548)..(1568)
  misc_feature/5'D7-PDS4 (1569)..(1589)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttacaagttaaggacatgtcgttacaagttaaggacatgtcgatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 188 - DNA, 4023 bp, Artificial sequence
  pRMW109 is the Gateway entry vector containing engineered Arabidopsis TAS3 gene TAS3/PDS3.  It is identical to pRMW38 except that 5'D7 and 5'D8 regions are replaced with a 21-nt sequences targeting to Arabidopsis PDS 1331-1351 region (PDS3).
  prim_transcript/TAS3-PDS3-ta-siRNA-precursor (683)..(1882)
  misc_feature/5'D8-PDS3 (1548)..(1568)
  misc_feature/5'D7-PDS3 (1569)..(1589)
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctcttttcatatgtgttcttcagtttttcatatgtgttcttcagttttatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagttggcattataaaaaataattgctcatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 189 - DNA, 9597 bp, Artificial sequence
  pRMW80 is identical to pRMW76 except that 5'D7 and 5'D8 regions are replaced with a 21-nt sequence targeting to Arabidopsis PDS gene 987-1007 (PDS2) region.
  prim-transcript/TAS3-PDS2-ta-siRNA-precursor (8083)..(9282)
  misc_feature/5'D8-PDS2 (8948)..(8968)
  misc_feature/5'D7-PDS2 (8969)..(8989)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttcctgaagaaaccggttcaattcctgaagaaaccggttcaaatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 190 - DNA, 9597 bp, Artificial sequence
  pRMW81 is identical to pRMW76 except that 5'D7 and 5'D8 regions are replaced with a 21-nt sequence targeting to Arabidopsis PDS gene 1394-1414 (PDS4) region.
  prim_transcript/TAS3-PDS4-ta-siRNA-precursor (8083)..(9282)
  misc_feature/5'D8-PDS4 (8948)..(8968)
  misc_feature/5'D7-PDS4 (8969)..(8989)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttacaagttaaggacatgtcgttacaagttaaggacatgtcgatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 191 - DNA, 9628 bp, Artificial sequence
  pRMW82 is identical to pRMW79 except that 5'D7 and 5'D8 regions are replaced with a 21-nt sequence targeting to Arabidopsis PDS gene 987-1007 (PDS2) region.
  prim_transcript/TAS3-PDS2-ta-siRNA-precursor (8114)..(9313)
  misc_feature/5'D8-PDS2 (8979)..(8999)
  misc_feature/5'D7-PDS2 (9000)..(9020)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttcctgaagaaaccggttcaattcctgaagaaaccggttcaaatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 192 - DNA, 9628 bp, Artificial sequence
  pRMW83 is identical to pRMW79 except that 5'D7 and 5'D8 regions are replaced with a 21-nt sequence targeting to Arabidopsis PDS gene 1394-1414 (PDS4) region.
  prim_transcript/TAS3-PDS4-ta-siRNA-precursor (8114)..(9313)
  misc-feature/5'D8-PDS4 (8979)..(8999)
  misc-feature/5'D7-PDS4 (9000)..(9020)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttgatccaatctcatccactgatccacaaaccgtaatcaccatcaaaatattcatgcaagtcaacttgaggatatttacatactataattaagaaaataccacaaatttccaaatcaagttttttttttttttttttggctattggcttaattaacaaacaagaatttggctattcacgtgattcaaagtctaaactaatgaagcccacttgacttttcgggcaactcatctaaaacttcaaactttgaaatctaatttaaaaatggacccatgacgttttacactctgactctccatagttgactccatgagtccatccaaatcgagtgtttggttacacagtgacatgaagttttaaaattctcgcgatctaaaacaagatatttttaaaatattcacgtgtataaaaacaagaaaatttaaaaatattcacgaggataaaaacaaaaagcacctattagaaatagctcttatccaataaggcaatgataacggactcgtgtcggtgtctacccatatcttattaatcgaaaaaaaaatcttagttagtccaaaactcacccccaaagagtcaactttgttacacatacgttcttatccaaaatccaaagttaacttattaacgactaatgccaactcaggtttacacatgacatcagagcttccaagtttatagtctggtcaagctgtaactgttaacttttaattacagtcaaggtctgtaattagaatttgatcacaaaacatgtttcattctataaacatatattaaaacgatgtggatgactcttgtccattggattcaaataactaaatcatctcttaacagtagcttgtggctttcacgactactgttttgtcaactattttttttctatataatcaccgaatcttttctttggtactgagagagcaagagagattagtaagacctaactcttaacgaacttttagataaaagcttataactgagagagacatagatcgacaaaagtctctataccttcttgtaacgtggtggttaattaaccatggaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctctttttacaagttaaggacatgtcgttacaagttaaggacatgtcgatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 193 - DNA, 9597 bp, Artificial sequence
  pRMW110 is a binary vector containing pPcUbi4-2::TAS3/PDS3::tNOS and pNOS::Bar-R::tNOS.  It is identical to pRMW76 except that both 5'D7 and 5'D8 regions are replaced by a 21-nt sequence targeting to PDS 1331-1351 region (PDS3).
  prim_transcript/TAS3-PDS3-ta-siRNA-precursor (8083)..(9282)
  misc_feature/5'D8-PDS3 (8948)..(8968)
  misc_feature/5'D7-PDS3 (8969)..(8989)
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttggctccgaattcgcccttagcttgactagagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccggatcaagggcgaattcgacccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctcttttcatatgtgttcttcagtttttcatatgtgttcttcagttttatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 194 - DNA, 9248 bp, Artificial sequence
  pRMW112:  Binary plant expression vector containing pUSP::TAS3/PDS3 ::tNOS cassette and pNOS:: Bar-R::tNOS cassette. Its 5'D7 and 5'D8 regions contain the same 21-nt sequence targeting to Arabidopsis PDs gene 1331-1414 (PDS4) region.
  misc_feature/attB3-part2 (1)..(14): complementary
  misc_feature/b-RB (69)..(214)
  misc_feature/b-RB-repeat (109)..(132)
  promoter/p-KanP (241)..(378)
  CDS/c_NptII(bps03) (379)..(1173)
  rep_origin/o-ColE1 (1470)..(2151)
  rep_origin/o-Rep-ColE1 (1471)..(1751)
  rep_origin/o-BOM-ColE1 (1891)..(2151)
  rep_origin/o-pVS1-origin (2525)..(2719): complementary
  CDS/c-RepA (2785)..(3892): complementary
  CDS/c-staA (4287)..(4916): complementary
  misc-feature/b-LB (5601)..(5815)
  misc-feature/b-LB-repeat (5647)..(5671)
  terminator/t-NOS (5833)..(6085): complementary
  CDS/c-BAR (6127)..(6678): complementary
  promoter/p-NOS(lm243) (6688)..(6974): complementary
  misc_feature/attB4 (6988)..(7008)
  promoter/p-USP (7010)..(7684)
  misc_feature/attB1 (7696)..(7716)
  prim_transcript/TAS3-PDS3-ta-siRNA-precursor (7734)..(8933)
  misc_feature/5'D8-PDS3 (8599)..(8619)
  misc_feature/5'D7-PDS2 (8620)..(8640)
  misc_feature/5'D6 (8641)..(8661)
  misc_feature/5'D5 (8662)..(8682)
  misc_feature/5'D4 (8683)..(8703)
  misc_feature/5'D3 (8704)..(8724)
  misc_feature/5'D2 (8725)..(8745)
  misc_feature/5'D1 (8746)..(8766)
  misc_feature/miR390_binding-site (8755)..(8776)
  misc_feature/attB2 (8956)..(8976): complementary
  terminator/t-NOS (8982)..(9234)
  misc_feature/attB3-part1 (9242)..(9248): complementary
attatacatagttgataagcgatcgcagcttggcgtaatcatggtcatagctgtttcctactagatctgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtccatgtgttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtaacgcgtggtgattttgtgccgagctgccggtcggggagctgttggctggctggtggcaggatatattgtggtgtaaacaaattgacgcttagacaacttaataacacattgcggacgtctttaatgtactgaattaacatccgtttgatacttgtctaaaattggctgatttcgagtgcatctatgcataaaaacaatctaatgacaattattaccaagcaggatcctctagaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgccggcgtcgacgatatcctgcaggtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggcgcgcctttggttgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcagatcagaagcttgctatcaactttgtatagaaaagttgtcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcgttccaagatgcccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccagtggcgcgccaagtttgtacaaaaaagcaggctccgaattcgcccttccatatcgcaacgatgacgtcaccaaattcatattttaaaactcgtttcgggcaacgacaacgtcatgatccctcccaaaggtctaattgggccccggcccacaaaggttatcatcttctttcttcttctttgtttattgttgcttttgccttaaaatctcttcttcatcatcccaccgtttcttaagactctctctctttctgttttctatttctctctctctcaaatgaaagagagagaagagctcccatggatgaaattagcgagaccgaagtttctccaaggtgatatgtctatctgtatatgtgatacgaagagttagggttttgtcatttcgaagtcaatttttgtttgtttgtcaataatgatatctgaatgatgaagaacacgtaactaagatatgttactgaactatataatacatatgtgtgtttttctgtatctatttctatatatatgtagatgtagtgtaagtctgttatatagacattattcatgtgtacatgcattataccaacataaatttgtatcaatactacttttgatttacgatgatggatgttcttagatatcttcatacgtttgtttccacatgtatttacaactacatatatatttggaatcacatatatacttgattattatagttgtaaagagtaacaagttcttttttcaggcattaaggaaaacataacctccgtgatgcatagagattattggatccgctgtgctgagacattgagtttttcttcggcattccagtttcaatgataaagcggtgttatcctatctgagcttttagtcggattttttcttttcaattattgtgttttatctagatgatgcatttcattattctcttttcatatgtgttcttcagtttttcatatgtgttcttcagttttatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcttatttgatttttgttgttgttggttatattattgcaacaaaattaaagggggtaaggaaggtctcgctatcaaggggactggcaagcttaagggcgaattcgacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 195 - DNA, 20 bp, Petroselinum crispum
gatccaatctcatccactga

SEQ ID NO: 196 - DNA, 20 bp, Petroselinum crispum
ccatggttaattaaccacca

SEQ ID NO: 197 - DNA, 20 bp, Arabidopsis thaliana
tcgagggaacaggagtgttt

SEQ ID NO: 198 - DNA, 19 bp, Arabidopsis thaliana
ctccggcttggatatgctt

SEQ ID NO: 199 - DNA, 19 bp, Arabidopsis thaliana
tccttgtacgccagtggtc

SEQ ID NO: 200 - DNA, 19 bp, Arabidopsis thaliana
cacgtccagcaaggtcaag

SEQ ID NO: 201 - DNA, 21 bp, Artificial sequence
  MW-P92:  Forward primer for detecting TAS1/PDS1 ta-siRNA at 3'D2 phase.  The last 16 nt are from PDS1 sequence.
attcattcttgtcttaagcgc

SEQ ID NO: 202 - DNA, 21 bp, Arabidopsis thaliana
gaaagtgactacatcggggaa

SEQ ID NO: 203 - DNA, 21 bp, Artificial sequence
  MW-P129:  Forward primer for detecing TAS3/PDS2 ta-siRNA in 5'D7 phase.  The last 16 nt are from PDS2 sequence.
ttcaattcctgaagaaaccgg

SEQ ID NO: 204 - DNA, 21 bp, Artificial sequence
  MW-P94:  Forward prime for detecting TAS1/PDS2 ta-siRNA in 3'D2 phase.  The last 16 nt are from PDS2 sequence.
attcattcctgaagaaaccgg

SEQ ID NO: 205 - DNA, 54 bp, Artificial sequence
  JD-dT#77:  primer used in Rt reaction for detection of ta-siRNA. V=A, C or G; N=A,C, G or T
  RT_Reverse_Primer_Sequence (1)..(19)
  Tagman_Probe#77_Sequence (28)..(35): Taqman probe region.
  misc_feature (53)..(53): V=A, C or G
  misc_feature (54)..(54): N=A, C, G or T
gcgagcacagaattaatacgactcactccaccaccataggttttttttttttvn

SEQ ID NO: 206 - DNA, 19 bp, Artificial sequence
  Taqman_Universal_Probe#77:  This Taqman probe has nucleotides modified with locked nucleic acid technology (Roche Applied Biosystem).  It is labelled with flurosceine FAM at 5' end and a dark quencher dye at 3'end.
gcgagcacagaattaatac

SEQ ID NO: 207 - DNA, 8 bp, Artificial sequence
  Taqman_Universal_Probe#68:  This Taqman probe has nucleotides modified with locked nucleic acid technology (Roche Applied Biosystem).  It is labelled with flurosceine FAM at 5' end and a dark quencher dye at 3'end.
aggagcag

SEQ ID NO: 208 - DNA, 8 bp, Artificial sequence
  Taqman_Universal_Probe#88:  This Taqman probe has nucleotides modified with locked nucleic acid technology (Roche Applied Biosystem).  It is labelled with flurosceine FAM at 5' end and a dark quencher dye at 3'end.
catcctcc

SEQ ID NO: 209 - DNA, 19 bp, Artificial sequence
  JD-Rev#77:  Reverse primer for ta-siRNA detection using Q-RT-PCR.
gcgagcacagaattaatac

SEQ ID NO: 210 - DNA, 1119 bp, Zea mays
  misc_feature (207)..(227): miR390
ctggccatgacatacacgcatggttaattagatctcgaacccttgtattcattcccatccgttcctgcttttggtcttgttcatccacagaccacagagagcccagccactacgtagatagatagatagatacatacatactcaacgaactggcggcgaggatctgaggagaattaggaaaaaagaagggtatggaacaacccttgaagctcaggagggatagcgcctaggaaaacacatagatcggagccggccgcgaggagaaagaaagagccaagagatatgtgtgatgaataatctacatggatcttggctagcttttgtgttctcctctggaggcgtggttctgtctatcaatctgaagcgctatctatcctgagctccacggcttgttcttaccacacgccggcggctggccggccggccggccgatcgatcgatcgatggagctccatcctcgctcccatatatgaataatgacctcttgccgtcgtctgcctcctgttcctgtacttgttgttcttgtgatatatgcagcatgcaggtgagcgtgcgtgagaggtcgtacgtagtctctcgtcaggtacacgcgcggacatgtcctcctagctagctttgcttgaggaagtacatacatgaacatccccagcactccagcagtacgtgggcattgctgcagtgtcctgctcctgcggccgaggtatctatctatctatctcctcctccgtccgatccctgctgctggtgctggctccgtccatgacttgtttactgtactctatgcccgtgcaagcgatgaggtgaggtctgcccgcgctcattcatgaatgcatgcatgcagagccgagcctctgccaaacaagcagtcatgggcacgccccgggtttcacttgctactgtagtacagagcttgcatgagtaaatgctgtgacccgtaaccgattctttcaagagcatgcgtggtacggtgcccatcgtcatctctactcatctgggagtatagtaaattaattcattcgttcatgaatgtaactgactgactaaaccacctactttagctgctcttgttgtgtgagaaaaatcgaaatggtctatctctgtgtaaaaaaaaaaaaaaaa

SEQ ID NO: 211 - DNA, 21 bp, Arabidopsis thaliana
ttggagaacttgggatcaatg

SEQ ID NO: 212 - DNA, 21 bp, Arabidopsis thaliana
ggcatagcaaaaatcatggag

SEQ ID NO: 213 - DNA, 11855 bp, Artificial sequence
  RJM152: identical to RLM423 except miR390 binding site replaced by miR172 binding site
  misc_feature (11207)..(11227): 5'D8(+) was replaced by 21 nt PDS-3 targeting maize phytoene desaturase
  misc_feature (11228)..(11248): 5'D7(+) was replaced by 21 nt PDS-3 targeting maize phytoene desaturase
  misc_feature (11364)..(11384): Native miR390 binding site replaced with miR172 binding site
attatacatagttgataattcactgggccggccagatcttgattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcgcaaatccgacgctgtcgaaaagcgtgatctgcttgtcgctctttcggccgacgtcctggccagtcatcacgcgccaaagttccgtcacaggatgatctggcgcgagttgctggatctcgccttcaatccgggtctgtggcgggaactccacgaaaatatccgaacgcagcaagatcgtcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgccgggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaaccccccccccccccccctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcccccgatcaagtagatacactacatatatctacaatagacatcgagccggaaggtgatgtttactttcctgaaatccccagcaattttaggccagtttttacccaagacttcgcctctaacataaattatagttaccaaatctggcaaaagggttgaccggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgaccgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcagggatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattggatccgcccgggcggtaccaagcttccgcggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacggatcctcatctaagcgcaaagagacgtactatggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaataacgtttcaacgcagcatggatcgtaccgagctcaatcgatcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggatgggcccaggtacagaattcgcggccgtacaacgcgtaccggttaattaaattacgccaagctatcaactttgtatagaaaagttgaggaagttgaagacaaagaaggtcttaaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacaagtttgtacaaaaaagcaggctggcgcgccggatccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctagattctcataccagaattaacgtagatagaaaccttcgataggtagatagaaaccttcgataggcactctgtgtctgcatccttctcgcatcccttgtttccttctttcccactacatgcaggatcagtcccgatattgccgtgtttgccagccttctgcatccacctactttctgttcctgcagcatcatcaggattccattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattctgcaggggggacccagctttcttgtacaaagtggagctcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggccggccaacttt

SEQ ID NO: 214 - DNA, 8 bp, Artificial sequence
  Taqman_Universal_Probe#86:  This Taqman probe has nucleotides modified with locked nucleic acid technology (Roche Applied Biosystem).  It is labelled with flurosceine FAM at 5' end and a dark quencher dye at 3'end.
gcagtgga

SEQ ID NO: 215 - DNA, 2020 bp, Arabidopsis thaliana
  misc_feature/miR390 (1000)..(1020)
  misc_feature/miR390* (1049)..(1069)
tagtcggcaggaaaatgacacaaacaaccatctaaaaagataaagtaagaactaaaaagtcttgacattcattagtttaatcattttctgttaacatatatggaaaaaacaaacttcaccgttatttacctgaatttacctatttgggtaagaattgtacctctggacctctagtattttatatacacctaaaaatataattttggtcgggaaaatataactctgtttaattaattaaattttcagtattgtgtaagtgtaattatagaaatcaattttatccgcgtaacaaaataatataaaattatactttcaaatccacgaatatatattgtgaagtctcatagtttgcaaataagcattggtcttcggccgacaaaaaaaaaagcattggtcttcgaatattttgaatatcggaccaatggtatataattaataatatgtggtatataaatacatatttatttaaatcacaataggatatgcaatgtgtgtatatatacatatacgtaattaaagtccgggttaaactgatagcatatattataatagatgcatctataattgttcgtcaacaaaagcattatcatgtattttgaattaagcttccttcatttctgtgaatcaaaaggcctcagaagaagaaactaaagtcaaacaatcaacgggatccaataaatcacatctggactatatagtatcaatactttccacactaaaaaagctaagaaatttaataaatacattattataggggggaaaaaaaggtagtcatcagatatatattttggtaagaaaatatagaaatgaataatttcacgtttaacgaagaggagatgacgtgtgttccttcgaacccgagttttgttcgtctataaatagcaccttctcttctccttcttcctcacttccatctttttagcttcactatctctctataatcggttttatctttctctaagtcacaacccaaaaaaacaaagtagagaagaatctgtaaagctcaggagggatagcgccatgatgatcacattcgttatctattttttggcgctatccatcctgagtttcattggctcttcttactacaatgaaaaaggccgaggcaaaacgcctaaaatcacttgagaatcaattctttttactgtccatttaagctatcttttataaacgtgtcttattttctatctcttttgtttaaactaagaaactatagtattttgtctaaaacaaaacatgaaagaacagattagatctcatctttagtctctttctccggtgcagtcagccaccgtcgggtaagtttcatctgtattttattaattaattacaattattagtgttcttattaccgttttggtaaaattagttaattaatgtcggtccaaacattctaaaccaattattctgaaaagggtgaacgccaatcagttatatacaatattcttacattaaagtagaatcggagatgttacatactaaccaaaagttacatatactagtatcattttctttaagatttgtttaggatttactcactttatagtgctcgcggttggggtcagggtaagtggggaacagatatgctctgcatgaaccacgtggaccaacatgcatatacacagttacatttattttttctagtaggttcatttgcaaattttccagtatcttgtatgttatcttcatggtgagttttttggtcgcatattcttggtgattcttcttctacgttttcactttcttcttcagagaccttattaatatgttaattgcatgaatttatgtaacattcaagaaaaagagatcgaatacaagaaaccggaaatttaatttctaatttgaattctatgcatgtttgtttctttgccaatttagtacgaatatatttatggtccggagttctaaccaaagatagttgctctgtatatagaagttatacatctcgcttgtttaaactaaataactatttagtttgtcttggtagtccagtgactttctgcaaacattgggatttata

SEQ ID NO: 216 - DNA, 2020 bp, Arabidopsis thaliana
  misc_feature/miR390 (1000)..(1020)
  misc_feature/miR390* (1070)..(1090)
tttagtcgtttttattttcattttacactcaccatcttccactttaaaacacttctctaaagttttaaaccaatgataattttattttattttttatagtgtgagataatgtattctattaattatacatttataatttgtagttcacaattcatttaccgtaatcaatgtagaatacatagaaataacaataaaatcaatatatatgaaacaaaagcaaaaacaagaaaaccgtttgtgatgaaatggatgtcatgaaattttgttgttgttgtggacataaatattgattttattgatatgataacattacaagattctgaaatagtcactacgtactaataataaatttggaaataaaggagaagtggagatcccacctacgccaaatattgaatgcatcaccgctttttgcgttcttccacatactggattatttcattttatcctttttattttcatacattctcacttatcgatctcattaaatatttccttcgtttccttttaatctcaaggacttgtctaaccggtgactagcttgtggccgtgctgagtttgcatcgtcgaacaaaactcataaaatcctatctgacgcagtcgcacaacagtttataattagacgtaattcgttgacaaattgccctatagatatatacagtatacattaactaaatctatcctctatcacctccctatttcttagtaaacaataaaagaaagaaataaagttattgtgggtatgggaatgcattaaaagtgccgaatatgcataaaaaattggtacaccttccaaaatatgtaatatggggacacttagcttagagttgagactataaatacagcaatatgatccaaggtcaagctcctctatatatatatatacgtacttaacattacaatacatataacatacatgatacattataacacatatgtaaaggaagatgcatacctatggatgtaaatttcagattgagtagtagagaaatagctataaagctcaggagggatagcgccatggctcaccagtgctgtatgttttgtatatgcgtacatgtatatctgttggcgctatccatcctgagttccatagcttcttcttgcttatatgtgattcctacttcattccctccttcgtttagcttcttgtatacaagatatggtaatgggtaagtttattatttgcatgtaaatattttacctttttttatatagaattgttgaagttcaaatcatatagaaaattgtgtcgaaagtgagaaaaatcgcaggtattgtcaatttgaggttaagaacacattaagtattaaatagtgtggtcttacaagttacaacttacaaatatctggatttcacacatctaagcagtttgttagaattacattgttactgccttactttttttttttttttttttttttgtaaatttatgcttaagactactggtggacttttattaagaatatgtatattatccaatatgtgtgtgaaagggatggtaaataagtaatatcgccgtgtgctagagccagccagcgattgagctgtgaatatgcaatgttagaagatggattctctttgtcgaattgagaatgggaatcttgaaactaatgttacaggattccaaatttcctggattctttctctcgtccatattttctacacaacaagtcattaataaactttctcttgggattttcggcattagtcttttttgttcctataatttcaacataaactttcgttacatgtaacacattaaagagttggccaatccggcacttgaccaaaaggtcatgacatatacacatagagaactttacgagacacccttctctttagtccttgggatccagattgaacgattaactatttattaacaacgtcttttatccaaaaaaaggccactcatttgtaaaaccctaatcctaatcatagccccagtgagtgaagttggcaataaaatcatcaagttgatctttgaaaggtcactgcatacttcagatcaactgatcag

SEQ ID NO: 217 - DNA, 2020 bp, Populus balsamifera subsp. trichocarpa
  misc_feature/miR390 (1000)..(1020)
  misc_feature/miR390* (1079)..(1099)
gtgtagagatattatttatcaaacattgtataagaagaagaatcgagtgaaaaaagaagaagatatattttggaatggagaaatttcaataaacacaagcaaatcatgcggttttgacaccatttatgctagatcatgaattgataaccagatctagcctccaatatttcatataaatctagacacttaacctgattaataaatgaatatgcgctagctccaagttatcattcactctcacacacacacacacacacacacacacacacacacatattctcataaattataattgaaattgttcaggtagtacttgaaaccaactattatcatggttttgataggagtgagcagctggtggttcaaactattcaatacatcattaatgatagccatggcatagttgtatgggaaatgcttggaagttgtaataactagcttgcttgcttgcttgccaattacttgctagttcaaaggtcaagaaatgggaagagtgtttattagacaatattgaggttctctccttctaacattactcaagacaaaatttgaaagaattcatggctgccatccggcaaagctgcgaaaaaataattttttttttaatttagagatttctactccatatgtaccgtatccgaagagagtgatagaatgaaatacgtagtcggcagaagtatagagtaagaagacaatagttcatgaacttaattgtacctcaaaatataaaatgtaaggaaatattaatacaaataaaatgagaaaaaaccgtccctctccacacatattatacttggtctaatgcccttccagtactcccctccctttataaatagactcctacccaccccttcattacccaccatttgagtcctgatgaatatattgaagagcttaattaggttctatagctatggctctttcaaatactacttgctttaggttttcttgacgcaggcttcaatggatgttgtacacacaagtacgggagaatctgttaagctcaggagggatagcgccatgagcatgacaaagtctatgtttgagttaatctcaacaaaatcaatccagtcatcagtggcgctatctatcctgagttctatgggttctccttactattctggtgcagtttcagcttcaaagatggttgttggcttctgggtgtgcgtacttttcttctataaatgcattcttaattaggttactactgtcctagattttctgttaagagacaaaaagcctggattctcgattacgtttggggttaaatatatcctccatcatgattttcttgttcttgttttgatttccagcagcataatcatatcaagatcaatggtgtggtttctttctttcttttccttcttacttattctacgatttttatgtacataaattagttaatcaaagatgctttaatggggtgttttttttttctttcttttattgactgggtttactttctcccttgttttggggtattttttttttgtttatttgcttcatattcgttaggttttggttatagcaagattgattatctgtggcccttttttcacaatccctctgtgtcgtggccgaattgtcaatggtatgttatcatagcaagagtaaatgatctgtggccctccatgttcgtcaagtaatttgttaacttattttattgttctctttttgtgtcgtggttgattatcccgctaagattgatatacatgcttctttgaacttggaccttttcagcttgcgatacaaatctctttggctaatggccgtatgtgggcacataccagctagttcccttcaaggttctaatctctatggattttttttttaattaggttaaaacccttggagtttgtattcgaattctttgttcggtttgcttgatgacatcagattaattaaccaggaatgttttatactgcctagtaatatcatggtcaattgggtaggttagggcttgcctttcgggtatgccaatcatcagtcctgttgctccactgtttagaaagattcttac

SEQ ID NO: 218 - DNA, 2020 bp, Populus balsamifera subsp. trichocarpa
  misc_feature/miR390 (1000)..(1020)
  misc_feature/miR390* (1066)..(1086)
actgtagacttcttacaaagtatattttctgagcgattgactgagtagctttgattggtaaattttgtttttttaattgagataagttttaagagcatttcccctcgttaatctgatataaataaataaatggcttcagaatcttaattctcaatccgaactcaaaaaatcgaaagaagatagcaccacctttaagttgtttgagccttactccatgaagaaagaatcatgctgagagatacgaaagttcgttctctgtttctgctactactgggcgttaaaaaaaaagcattgaaattggaaccacagttgctttcattatgattgaccataaatattattttatgcaggagaaagagaagtgaggaaaatgacctaattgcgccaacaaggaggtagctacagtgatagttcataattaagcaagctataaactcccacaccatggtcctgcctcttgaaaatttaagtgattaacactatattatgtacgatggtaatcattaaccagaagattaactaaaaaggagaagtaatcatgaagcaaaggaagagtggggtacagtatttcaccgaagaagaaaaggaaatcttaaaagtatcaacagtacatacacagtataacccttcccatatgtcattatacctgtaccgtagtcggcagagacattaaataaccattgagattcaacaacaacaaaaaaaaaaaaaaaaaaaggaaaaacaaaaaaaaaaagagagaaggaaaaaccgtccttctaatttgcacagacactgtcatttgtcaaaaaatgagggtttttagtcaagttctcatgggactccagaaatgacatgtggcttcacttccccacgttgtgtttatcagtttctgctataaatacagctccccctcctttgaactttccccaccattaccagctagagcatcggtttaggtccctttgaagctaaatagctgcaaggcttgatgcatagaaaagtatggaagaatctgttaagctcaggagggatagcgccctaaggataatcatgggctctttttatgtggtttttgattctcagtggcgctatccatcctgagtttcattgcttcttcttgctaccagctcctggcctctctctgttgggtcttgaagtgccattaattccagcttttttgagaaggtgatttgttactggtatgtactagcgtttgcttttaaattcatttcttatcgggtttctcatgtttcttgttgtagttgccatggttattgaggggaatttcctttgaataagtggagtattaatgatagtttctgttcgaaggccattatgagttctgcgctcatgctgtggaaaccatcatagattgatcttaattcagaaatatgccattgatggaagttaaatggatagtccatattgaactatttatgtacataaattgataatgtttttccttcttgacatgctaattacggttatggagggagttaatcgtttgctctacacatggatggatggattatgatagcgattgtgtgattgtgattgtgatggcgatgattatattagcaacacaaaactccaaaataaaagtaacagtttgtaataataataatacagaaacaaaataatgcagggctagcttatccatttatcaaatttggtctgggaggatgaacttgaagatgctgactgcttcccatcttcgtgcaagtcacggccctcggtcatgttctttcgagtcgtttcctttactttaattatatctataaaaaaataataattaaggcaaaggtttgtgcaattaagtaatatctgcactcatttacagctttaattctgatattttgccccctttccaggtgaccgtgtttccacgctgcttccgttgcttccactgaaagatctccggtgattgatagctttagaccagttccctatattatagtagaatctttttagattttaattttcttcacggaattaatttacagtgaagtaattataaaatgatgttaccagggcatag

SEQ ID NO: 219 - DNA, 2020 bp, Populus balsamifera subsp. trichocarpa
  misc_feature/miR390 (1000)..(1020)
  misc_feature/miR390* (1083)..(1103)
caaatatatttaatccttcaccatcgtaacaggaagaagaattaggtaagaaatcaggatatgtttcggacaggaaaactctcatcaaacacaagcaaaaagcattaggttttgactctgtacaaatgctagatcatggatcgtaaactggatattgtctccaatttatatatataactctctatctctagaggcttaacggattggtaaatgagtgtctgtatatatgtgtgtgtgtgcatatatatatatatatatatatatatatatatatatatatatataatcatcttataattgaactcgacgttatggagaacaaatattactatatggttttgatcagccgtaaacagctggtttccaaacaattcaatgcctcattaatgctaacaacgataaccatgtcattgctgtattggaaatgcttggaggttgaaactagctagctcgcttgtcaattaccatctagtccaaattgtccagtggtcaagatatggtagagtgcatattagacaatattgaggctccctccttctaaacattactcgagacaaaatttgaaagaattcatggctaccatgcggcaaagctgcgagaaaataaaaaataatttcgaatttagaaaattataggccatagtccataccgtatcccgagtgatcttcctagcatgaaagacgtagtcggcagaggtatatatagaggtaaagagtaggaaaaacattacacatggacttaaaccataatataaaaatataagaaaatactactacaaataaaatgataaaaaaaccgtccttccataatgctctaccacgttcctccctttataaatagactctcaccctcctttgcacccaccaccatgtgagtcatgacttgaggagcttcattagctagctcccagctatggctctttcaaattttgcttgcttcaggctttcttgataaaggcttcaaatggatgatatgtgcataagtatgggaggatctgttaagctcaggagggatagcgccatgagctgatgataagttgatgtttgatgggttaatctcaacataatcaatctagtcattagtggcgctatctatcctgagttctataggttctccttgctattccggtacagtttcagctttaaagatggttgctggcttctgggtatgtgtgtacttttcttctataaatgcgttcttaattaggttacaatttctctccttcgctagattttcttttaaaagacaagagcctagattcatgatcatgtttggggtattttggataaatatatccttgatcttgccatttttgttcctggttggattttcagcagtatgatcataccaagatcaatgatgtgcgttttattttctcttccttctaactcaatacgatatttatttacataagttggttcaagatgtattttttcttgttttggctctagtttcctggaattagcgtcatgagggaagctccacatctttgcaaggacaaaccccggctttatcttccctgttctgggtttttatttatttatttacatgctttatatcagtaaggttttggtaatagaaagataaatgatctttggtcttttttccacaattcctttgtttcatggcccagattttcactgggatgttatcattgcaaaataaaatgatctgtgatcattcatgcttatcaggtaattaggtatgttattttatttctaacttttgctatcgcggttgattatcccgtttagattgatatttatgtctctgaaattgtaattgttttcagcttgcaatcttaacctctttggcttatgtgatgctctagttagtttccttgaacggttctgatctccatgattttctcaattaggtaaaaaccccaggaattcgtgatctatttcttcgtctggtttgtataaataataagattaattatgcagcaaggtttttatactgctgagtaatattatgaattgggtacgttagggtttgtcttttgggcatgccaatcatc

SEQ ID NO: 220 - DNA, 2020 bp, Populus balsamifera subsp. trichocarpa
  misc_feature/miR390 (1000)..(1020)
  misc_feature/miR390* (1066)..(1086)
caagatataaacttctgcaccatagtcttgcctgttgaaaaaactacgacggtaatcattaatcagaagattaactagaaaggataagtaagtaatcatgaagcaaagaaattgtgggagtacaatatttcaccaaagaaagaaagaatgtacgtataccgtataaacctccccgtatatcattgtattccaaccgtagtcggcagagacattaaatacgctttgaccctcaaccaaaaaaaccattgaaaactaagcattgatttgttctgcataataaaatatttggcttgaattttttttttttgataaaatattttttaatgatgataatagaggaggaagaggtactgagagatcgtggtgattatagtattagactattagtgactgtgagatgatgatgggtcaagaaggtaatgaaatagttaaataatattctaaaaatattattatttataaaatattttataaatttttatgacttgaaattattttttttaaaatgaaatagttgtgatggtaataaaaacaatgatagttaaaataattaaatgatattataaaaagattattatttataaaatattttataaaagttttatgagctgaaattattttcaaacaaatgaactaaatttcaagattaacagtaaaatattttttattgaagaatttttctttgaaatattttaggagaaacgaacacaaaaaaaatccataaaacatttttctataaaaatattgtatacaaaacaaacatcccctaaaccagaaaacactgttatttgtcaatgagggtatttagtcaagttcttatggggctccagaaatgacatttgtcttcacacccccacgttctcttatgagtttctgctataaatacaccttcccctccttcaaaccatccccaccattactaacctcggctatggttttggtccctttgaagctaactagctgaaaggcttgatatatagaagtatggaagaatctgttaagctcaggagggatagcgccctaaggataaccatgggctctttttatttggtttttgactatcagtggcgctatccatcctgagttttactggttcttcttgctacgatcagctcctggctcctccctgctgcttcaggattaaagtgtcattccttctcttcgagaaggtgatttatgtgcggtatgattcattagcgcttttatgtttatatatttcttgttgatatttctttttgtagtttccatggttaattagcgagggaaaattcctatgctcatgaatatatgaataaagtatatatttatgacatatggtttctgttcaaagggccattatgagctatgtgctcatgcctggaaaccatcatagcgtaccttcgttcagaaatacgccattgatgaaggtaaaatggttgatgcatactcactatttttgcacatatgttgataatgttttacatttatctacatatcatacctctgcttatacagctctattacactgttttggttccctcttggcactctgatcatggttatggagggagctaaacttctgctttacatataaagatgaaagtgattgtgatggtgatgatcataatacctacaaaaaaaaaactctaaaataatatcagtttacaatagtaattataatacagaaacaaaataatgcagggctagcctatccatttgtcaattttgggagttgggatgatgaacttagcgactttgtcttcttcccatcttcgtgcaagtcacggttcctagctagtctttttgtgtcttctactttacattacatcagttatctaaccctttaagacaagggtttgtgcaattaatatctgcactcatttccagctttaactctgatattttactcccttttcaggtggctgtgtttccacgcttcctccattgtttccactaaaatatctcaagtggccattttagatttgttttctatatcacagcagaatcttttcggattttaacgtgttcatggaatttacag

SEQ ID NO: 221 - DNA, 2000 bp, Oryza sativa
  misc_feature/miR390 (590)..(610)
  misc_feature/miR390* (624)..(644)
aggatccatccaagtagttgatctgatgatgcatcatgcatagatggccatgggcacccatgtattggcatatattgcagtaacagtaagtataggcagcttgcaattgcaatgcattgcttcaattaaaagcaagagctagctggagatggagagaacttacacacagatcaaagagaagactctcttccccctcctcctccccctctccctcccccatacctcaagaaatgtgacagttgtctcctttcacatttcacaaaaacatgagagagagagagaagagaagagaagaggagagagagagagattgatactactccagctactagtattattctctcactataaatagagcaagaggcaccactgggccaatccatcctcacttcttcccctatcatcacctcactcatcaacaccttcattacttctctagctagctcacttctctccaccatgcatgaaggatctcatggcctttgtttcttcttcttcttcttcatccacctcttgtcgagggaagtgaggactcttttaggcgttcaaagggagagatgttttgaggaagggtatggaacaatccttgaagctcaggagggatagcgcctcgaaatcaaactaggcgctatctatcctgagctccatggtttgttcttaccacacgaccaattaaatctgcagtctccacgcacacctctgaagttttcattgcttgccacagttcagtaccgaaaggtgagctatttgcatatagctgtctgttctactctgtccatgagatgggcatgcactctatagctagcttagcttgattacctctttgcttttcttgcacctggtcatgccatggtgctaactatagcttttgcttcttctgacttctcttggttagtttactgtatactccatgcatctatgtgcatgaaaccatgcatgtataaatgtattcattcatgaaccagcatgcatgcatgtcgttgattgataggttatgggcatggccttaacttgctaccctacaagaacgaagtaaatgctgacctaaccaattcatgagcatgttccatgataatgcaaaatatcaataatcctgcagtctgccaaagaccacacaagccattccctccatatctacctctaataaaccttggagaaatacttcttttgaactcttttttcataagttagattttcaaaataaatgcgcacataaattttttatatatacattataaacacagacgctaaaccacatacttttattattattgttgttggtggtggtggtgttgttctctggtttgcgtgattgtctgtgcaactttgcgtgcatgtttcagttctgcaacaagtgtactccatatattcagttgagttgcagggaaggtgcagctacgagtgatgggtgtaatgcaggatgagacccatacgagctagcacatgatgcaacagctatagctgcctctccctgcaaaattggttgtaaaaaaggcctatcattcatttacctgtgtgcgcatttgatggctagctgccacttcaggtggtccgtccgatcctctatggctgataactcaatggcccagaatgcgccacgtaggtaagtatacataccgtagtgtgtactattggggcagtataacgtaccaagatctccctgttttccattggtttttctcaaggaaaatttctacagtagttattgtaactagatgcagtacactgcacagcagaggagcgtctgattctttcttttcgtctttttttctattgcaagcttgtacagtacgtacctttatagagtacaggtactagtactatatttttctacatatttttgttgtatcagtaaatatagcgcagagagtacatctgtacaggctatgtgtactagatgcccagtatatatggtagagtattagaaaagagacagagctctttttttaatggtaatttctcagtcttcgacaaattactgtaccttattagctacgtta

SEQ ID NO: 222 - DNA, 2030 bp, Brassica rapa
  misc_feature/mir390 (1004)..(1024)
  misc_feature/mir390* (1064)..(1084)
ctattagaataaattaaacaaccacattaaccatataataaaaatttagattttatgtatatgttatattttgaatttttttaaacgattataaattactaaaactattaaaattttcacgtttaaattttgtgatccatggttaaaaattttggttattacaaaatacaaatgattacaaaatcatataagtttaaaaactaatttaattaattactaacattaaaagatatatatatcgttttaaattaaactgtataccatataaaatacataaatattttaattttgaaatttactttgaacatttttttggataaaagttttgaacaaactttgacaacttaatttttaaaaaattataaattactaaaactattaatcccgcaatgaaaattatgttatcagtaatttaaagtttttgatataaaaaatacaaatgatcaataaatcatatgaatagaaaacatcattcaatagacattaatattaaaaatattgtttggattaataaattgatttatatgttcgcaccaatttaatcatctatgtaatagttattgaattttaattgtgtaatatatatttattatttcataatatgtaaaaacatataatacataaataatatatatatataatatttatcccacgcaagacgcggatcttaacctagtgcatacaataaaagatagatttttacttattttgaatatattatttagaatatcattgaatctataatactatacatgcataatatattctttcagattcctctttcatagtaaaaaatacatttattgtgggtatgggaatacattataaaaactggtacagtttatttaggacacttgagactataaatacagcaacgtgatccaagacgaagctcctctctaacattacatatctacatgcatgcttgtagagaaacgcatatggagagaggaagatgcatatgcatgcaaaacgcaggtggcgtagtagagaagtagctgtaaagctcaggagggatagcgccatgactcatcaccattactatatgtctttgtatatgtaatggcgctatccatcctgagttccatggcttcttcttgcttttatgtatatgtatgtatgtctctatcccgcatcggtgagagttttataaacgagatggtaacaggtaaggtttaaaaattgttgtctttttatttgttgaagtagacggatgcatcaggttcattacagtatatgcaattttcagatgtttggtacgtgaacaaataaaatgaacgactaaatttaaatcatatggaagttgtataggaagcgagaaaaaagaatcgcaagtttggtcgcacataaatttggatttgaactcgttaatccaattttatctcaagagcactcgactgaaaaaaaaatgtgtaatctgatataagatttggattttaatattttcacacattttttaagtgatccacttagtgagaaatcagaatcacatttctcaggtttagaggttgtgaagttgtactgattcttaattacagtccaccacacttatgtgtaacatccaattctgtactatgtgggcgaatttaaaatcacaatgtgatggtaggtgcagagcgttaaaccaaaaataatgtggttacaccattgagaagaggatccttgtcgaattgagaaataaaatcacaaaataagagaatccattacgttttcttttgtggtagaatttagacgttcaacataagcagttccagttatgatggattctatcaactaacatatttagacgattagtaaaaacaaataacaataaacaaatgattaaagatccttttattctttcagaacatgtcggcaactataggaaatatcaaacaggtctaactcagacatcaacaatatcccaactggctattgtcgtgtcaagacgcatcttaaaagacctgatgagatacccttctctttggaactacttatattgacctaaaaccgccactggttcgtaaatactcagagctagctatatatag

SEQ ID NO: 223 - DNA, 1990 bp, Medicago truncatula
  misc_feature/miR390 (924)..(944)
  misc_feature/miR390* (992)..(1012)
catttaatttataacatttctcttgaacaattgaaggagaagaattttttcccccatagaatatcatgatttaaacatgtagattataagctagaaaattcaagctataaataaataaaagaattaattaattgttcacaatgagaatcatataactagatcttctgcttttacctgagaagtgcaacataaatggtgctaccaattatttgaaatacagtgaaaaagtggaaacttttgaagtactaaatcaaaagagagaaaaaggatcttgcaataaacttgacaaccattggcttgtgacattccatttctgccactttcttcttcttcatggtcaatgattgaagccaaggtgaagcttgagagtctaattttatcaaaatcacagtggtatatatcgtaatttggtcaaactcaccataaaactaaacatacactcatagcttaaaaaggttaaaaaagaaatgttagttgataaaataaccatacataaaaaataaaaaaaaagaagcacaacaatttagagtaatgcaacaaccttgtatagtgcatcatgatgaagaaacacacaaactgtaacaaaatagccaaaaatcaaccaaagaggattcattgcttaaattagcaataaattttgacaaaattacagtgacaccgtaattttaatttgttgaaacttcaaattcaatttttgtcaaaacaacggtaacacactctaattcagtcaatcgttaatccaaacatgcactagtcttatgaaacaaaattaagaagcagaagaacaacaaaagtataatgaaacaaccttgtatagtgcatgatgatgaacatcataacaattagccaaaaacctgaaaagggtaccttaaattatgcaggatgatgaaccaagagatggaagagagtatgaagaagccatgaaactcaggatggatagcgcaagagaagatcaatcaataaaatggaaccaaaaaaagaagacattctatggcgctatccctcctgagcttaacagattctttcacacaaaaaatacaagagctatagcattgagttgaagcttataataaaccaactaactcattttaaataaataaattatttaattaaaatgcttgctaggtagataccattattatgaaacatttattgcttctgatacatggtggggagggacgtaacagaggtatttatagaagcagagaagggaaagtacgtgggcacattcagaaaaattaaacctacttttttgaaaataatataaaataagagtataggtccaaatcggtacttaagaaaaaacagtgacatatattgtatttgattattacacttacacacattaaatatgtgatgatggaattaattttaattgttcatgatgtagataaactagcggcgcgaatcgaagacgaagtagcacgtaagaggtttatttaaaatggtgcagattttatatctggtgttagaatgactcgagttatacctttttgaaaagcctcagaccttacgagcgaaactcatcactttgccatgccgtatggattattttagtcattctaggtcatctgaagacccgaaaccaccttttaatttttcagcgtattctagaatattctattttatttcggtgtgttatttttcagtccatgcgagtttgttatttcttttagtatttaaacaaaacttatgcaacctaagagactcttttcattcaataaaaatattcgagacttttctctcaattatggtggatttcgaaaatccttacttgataggtttgtcgcttgctacatgtttgttagcgcttggtaacccttgcttatgtactgcgtcagttcaagtttaaatcaacggtgtaaattatttaaatattatttgacgaaggtgtaatgtgagtcaataaatctcaagagttatattatttgatcataaaaaaatgatacatttatgatgaaggttggtaactcgtatctctttaaacctt

The invention claimed is:

1. A method for silencing or attenuating expression of at least one target gene comprising introducing or expressing in a plant or a part thereof a chimeric ribonucleotide sequence comprising a modified ta-siRNA sequence, wherein said modified ta-siRNA sequence is modified from a natural ta-siRNA sequence which comprises at least one microRNA binding site and at least one phase region by:

a) replacing the at least one phase region of said natural ta-siRNA sequence with a sequence which is substantially complementary to said at least one target gene and is heterologous to said natural ta-siRNA sequence; and b) replacing the at least one microRNA binding site of said natural ta-siRNA sequence with the sequence of a microRNA binding site which is substantially complementary to the sequence of a microRNA present in a plant;

wherein said natural ta-siRNA sequence comprises a sequence selected from the group consisting of the sequence of SEQ ID NO: 1, 2, 3, 4, 5, 6, 7, 8, 9, 10, 11, 12, 13, 14, 15, 16, 17, 18, 19, or 20 and a sequence having at least 98% identity to the sequence of SEQ ID NO: 1, 2, 3, 4, 5, 6, 7, 8, 9, 10, 11, 12, 13, 14, 15, 16, 17, 18, 19, or 20.

2. The method of claim 1, wherein the at least one phase region of said natural ta-siRNA sequence to be replaced is selected from the group consisting of:

a) a phase region described by nucleotides 688 to 708, 667 to 687, 646 to 666, 625 to 645, 604 to 624, 583 to 603, 562 to 582, or 541 to 561 of SEQ ID NO: 1, b) a phase region described by nucleotides 585 to 605, 564 to 584, 543 to 563, 522 to 542, or 501 to 521 of SEQ ID NO: 2, c) a phase region described by nucleotides 525 to 546, 504 to 524, 483 to 503, 462 to 482, 441 to 461, 420 to 440, or 399 to 419 of SEQ ID NO: 3, d) a phase region described by nucleotides 591 to 612, 570 to 590, 549 to 569, 528 to 548, 507 to 527, 486 to 506, 465 to 485, or 444 to 464 of SEQ ID NO: 4, e) a phase region described by nucleotides 595 to 616, 574 to 594, 553 to 573, 532 to 552, 511 to 531, 490 to 510, 469 to 489, or 448 to 468 of SEQ ID NO: 5, f) a phase region described by nucleotides 396 to 416, 375 to 395, 354 to 374, 333 to 353, 312 to 332, 291 to 311, 270 to 290, or 249 to 269 of SEQ ID NO: 6, g) a phase region described by nucleotides 469 to 489, 448 to 468, 427 to 467, 406 to 426, 385 to 405, 364 to 384, 343 to 363, or 322 to 342 of SEQ ID NO: 7, h) a phase region described by nucleotides 482-503, 461-481, 440-460, 419-439, or 398-418 of SEQ ID NO: 8, i) a phase region described by nucleotides 504 to 525, 483 to 503, 462 to 482, 441 to 461, 420 to 440, 399 to 419, 378 to 398, or 357 to 377 of SEQ ID NO: 9, j) a phase region described by nucleotides 510-531, 489-509, 468-488, 447-467, 426-446, or 405-425 of SEQ ID NO: 10, k) a phase region described by nucleotides 301 to 322, 280 to 300, 259 to 279, 238 to 258, 217 to 237, 196 to 216, 175 to 195, or 154 to 174 of SEQ ID NO: 11, l) a phase region described by nucleotides 373 to 393, 352 to 372, 331 to 351, 310 to 330, 289 to 309, 268 to 288, 247 to 267, or 226 to 246 of SEQ ID NO: 12, m) a phase region described by nucleotides 445 to 465, 424 to 444, 403 to 423, 382 to 402, 361 to 381, 340 to 360, 319 to 339, or 298 to 318 of SEQ ID NO: 13, n) a phase region described by nucleotides 203 to 224, 182 to 202, 161 to 181, 140 to 160, 119 to 139, 98 to 118, 77 to 97, or 56 to 76 of SEQ ID NO: 14, o) a phase region described by nucleotides 1084 to 1105, 1063 to 1083, 1042 to 1062, 1021 to 1041, 1000 to 1020, 9799 to 999, 958 to 978, or 937 to 957 of SEQ ID NO: 15, p) a phase region described by nucleotides 436 to 456, 457 to 477, 478 to 498, 499 to 519, 520 to 540, 541 to 561, 562 to 582, or 583 to 603 of SEQ ID NO: 16, q) a phase region described by nucleotides 592 to 612, 613 to 633, 634 to 654, 655 to 675, 676 to 696, or 697 to 717 of SEQ ID NO: 17, r) a phase region described by nucleotides 556 to 576, 577 to 597, 598 to 618, 619 to 639, 640 to 660, or 661 to 681 of SEQ ID NO: 18, s) a phase region described by nucleotides 226 to 246, 247 to 267, 268 to 288, 289 to 309, 310 to 330, or 331 to 351 of SEQ ID NO: 19, and t) a phase region described by nucleotides 1013 to 1033, 992 to 1012, 971 to 991, 950 to 970, 929 to 949, 908 to 928, 887 to 907, or 866 to 886 of SEQ ID NO: 20.

3. The method of claim 1, wherein the at least one microRNA binding site to be replaced is selected from the group consisting of:

a) the binding site described by nucleotide 698 to 718 of SEQ ID NO: 1, b) the binding site described by nucleotide 594 to 615 of SEQ ID NO: 2, c) the binding site described by nucleotide 536 to 556 of SEQ ID NO: 3, d) the binding site described by nucleotide 601 to 622 of SEQ ID NO: 4, e) the binding site described by nucleotide 605 to 626 of SEQ ID NO: 5, f) the binding site described by nucleotide 405 to 426 of SEQ ID NO: 6, g) the binding site described by nucleotide 478 to 499 of SEQ ID NO: 7, h) the binding site described by nucleotide 492 to 512 of SEQ ID NO: 8, i) the binding site described by nucleotide 514 to 535 of SEQ ID NO: 9, j) the binding site described by nucleotide 521 to 541 of SEQ ID NO: 10, k) the binding site described by nucleotide 311 to 332 of SEQ ID NO: 11, l) the binding site described by nucleotide 382 to 403 of SEQ ID NO: 12, m) the binding site described by nucleotide 454 to 475 of SEQ ID NO: 13, n) the binding site described by nucleotide 213 to 234 of SEQ ID NO: 14, o) the binding site described by nucleotide 1094 to 1115 of SEQ ID NO: 15, p) the binding site described by nucleotide 424 to 445 of SEQ ID NO: 16, q) the binding site described by nucleotide 580 to 601 of SEQ ID NO: 17, r) the binding site described by nucleotide 544 to 565 of SEQ ID NO: 18, s) the binding site described by nucleotide 214 to 235 of SEQ ID NO: 19, and t) the binding site described by nucleotide 1022 to 1043 of SEQ ID NO: 20.

4. The method of claim 1, wherein the at least one target gene is selected from the group consisting of plant endogenes, transgenes, and genes from a plant infecting pathogen.

5. The method of claim 4, wherein the plant infecting pathogen is selected from the group consisting of viruses, fungi, bacteria, insects, and nematodes.

6. The method of claim 1, wherein the microRNA present in the plant is selected from the group consisting of endogenous plant microRNAs and transgenic microRNAs.

7. The method of claim 6, wherein the microRNA is tissue-specific expressed, spatially-regulated, developmentally regulated, or by biotic or abiotic stress factors.

8. The method of claim 6, wherein the microRNA is described by any of SEQ ID NO: 78, 79, 80, 84, 85, 86, 87, 88, 89, 90, 91, 92, 93, 94, 95, 96, 97, 98, 99, 100, 101, 102, 103, 104, 105, 106, 107, 108, 109 or 110 or the microRNA is derived from a precursor sequence.

9. The method of claim 1, wherein said chimeric ribonucleotide sequence is expressed from a DNA expression cassette comprising a promoter functional in a plant operably linked to a nucleotide sequence encoding said chimeric ribonucleotide sequence.

10. The method of claim 9, wherein said promoter is selected from the group consisting of constitutive promoters, tissue-specific or tissue-preferential promoters, inducible promoters, developmentally regulated promoters, and promoters regulated by biotic or abiotic stress factors.

11. The method of claim 1, wherein silencing or attenuating said at least one target gene results in an agronomic trait.

12. The method of claim 11, wherein said agronomic trait is selected from the group consisting of disease resistance, herbicide resistance, resistance against biotic or abiotic stress, and improved nutritional value.

13. The method of claim 1, wherein the at least one target gene is selected from the group consisting of genes involved in the synthesis and/or degradation of proteins, peptides, fatty acids, lipids, waxes, oils, starches, sugars, carbohydrates, flavors, odors, toxins, carotenoids, hormones, polymers, flavonoids, storage proteins, phenolic acids, alkaloids, lignins, tannins, celluloses, glycoproteins, and glycolipids.

14. A chimeric ribonucleotide sequence comprising a modified ta-siRNA sequence, wherein said modified ta-siRNA sequence is modified from a natural ta-siRNA sequence which comprises at least one microRNA binding site and at least one phase region by:

a) replacing the at least one phase region of said natural ta-siRNA sequence with a sequence which is substantially complementary to a target gene and is heterologous to said natural ta-siRNA sequence; and b) replacing the at least one microRNA binding site of said natural ta-siRNA sequence with the sequence of a microRNA binding site which is substantially complementary to the sequence of a microRNAs present in a plant;

wherein said natural ta-siRNA sequence comprises a sequence selected from the group consisting of the sequence of SEQ ID NO: 1, 2, 3, 4, 5, 6, 7, 8, 9, 10, 11, 12, 13, 14, 15, 16, 17, 18, 19, or 20 and a sequence having at least 98% identity to the sequence of SEQ ID NO: 1, 2, 3, 4, 5, 6, 7, 8, 9, 10, 11, 12, 13, 14, 15, 16, 17, 18, 19, or 20.

15. The chimeric ribonucleotide sequence of claim 14, wherein said microRNAs are endogenous plant microRNAs or transgenic microRNAs.

16. The chimeric ribonucleotide sequence of claim 14, wherein said target gene is selected from the group consisting of genes in a plant and genes of a plant infecting pathogen.

17. A deoxyribonucleotide sequence encoding the chimeric ribonucleotide sequence of claim 14.

18. An expression construct comprising a promoter functionally linked to a nucleotide sequence encoding the chimeric ribonucleotide sequence of claim 14.

19. The expression construct of claim 18, wherein the promoter is a promoter functional in a plant.

20. An expression vector comprising the chimeric ribonucleotide sequence of claim 14, or an expression construct comprising a promoter functionally linked to a nucleotide sequence encoding said chimeric ribonucleotide sequence.

21. An isolated transformed cell or plant comprising the chimeric ribonucleotide sequence of claim 14, an expression construct comprising a promoter functionally linked to a nucleotide sequence encoding said chimeric ribonucleotide sequence, or an expression vector comprising the chimeric ribonucleotide sequence or said expression construct, wherein said transformed cell is a microorganism cell or a plant cell.

22. The isolated transformed cell or plant of claim 21 comprising said expression construct or said expression vector inserted into its genome.

23. The isolated transformed cell of claim 21, wherein said cell is selected from the group consisting of bacterial, yeast, and plant cells.

24. The isolated transformed cell or plant of claim 21, wherein said cell is a monocotyledonous or dicotyledonous plant cell, or said plant is a monocotyledonous or dicotyledonous plant.

25. Seeds of the isolated transformed plant of claim 24, wherein the seeds comprise the chimeric RNA sequence, expression construct or expression vector.

26. The method of claim 1, wherein the natural ta-siRNA sequence comprises a sequence having at least 98% identity to the sequence of SEQ ID NO: 1, 2, 3, 4, 5, 6, 7, 8, 9, 10, 11, 12, 13, 14, 15, 16, 17, 18, or 20.

27. The chimeric ribonucleotide sequence of claim 14, wherein the natural ta-siRNA sequence comprises a sequence having at least 98% identity to the sequence of SEQ ID NO: 1, 2, 3, 4, 5, 6, 7, 8, 9, 10, 11, 12, 13, 14, 15, 16, 17, 18, or 20.

* * * * *